United States Patent 11,464,842 (COMPOSITIONS AND METHOD FOR OPTIMIZED PEPTIDE VACCINES USING RESIDUE OPTIMIZATION) - sequence listing, part 2

SEQ ID NO: 12316 - protein, 10 aa, Artificial Sequence
  Description of Artificial Sequence: Synthetic peptide
  Seed: GAGDVGKSAL (KRAS G13D)
GPGDVGKSAM

SEQ ID NO: 12317 - protein, 10 aa, Artificial Sequence
  Description of Artificial Sequence: Synthetic peptide
  Seed: GAGDVGKSAL (KRAS G13D)
GPGDVGKSAP

SEQ ID NO: 12318 - protein, 10 aa, Artificial Sequence
  Description of Artificial Sequence: Synthetic peptide
  Seed: GAGDVGKSAL (KRAS G13D)
GPGDVGKSAR

SEQ ID NO: 12319 - protein, 10 aa, Artificial Sequence
  Description of Artificial Sequence: Synthetic peptide
  Seed: GAGDVGKSAL (KRAS G13D)
GPGDVGKSAT

SEQ ID NO: 12320 - protein, 10 aa, Artificial Sequence
  Description of Artificial Sequence: Synthetic peptide
  Seed: GAGDVGKSAL (KRAS G13D)
GPGDVGKSAV

SEQ ID NO: 12321 - protein, 10 aa, Artificial Sequence
  Description of Artificial Sequence: Synthetic peptide
  Seed: GAGDVGKSAL (KRAS G13D)
GPGDVGKSAW

SEQ ID NO: 12322 - protein, 10 aa, Artificial Sequence
  Description of Artificial Sequence: Synthetic peptide
  Seed: GAGDVGKSAL (KRAS G13D)
GPGDVGKSAY

SEQ ID NO: 12323 - protein, 9 aa, Artificial Sequence
  Description of Artificial Sequence: Synthetic peptide
  Seed: GAGDVGKSA (KRAS G13D)
GPGDVGKSC

SEQ ID NO: 12324 - protein, 9 aa, Artificial Sequence
  Description of Artificial Sequence: Synthetic peptide
  Seed: GAGDVGKSA (KRAS G13D)
GPGDVGKSF

SEQ ID NO: 12325 - protein, 9 aa, Artificial Sequence
  Description of Artificial Sequence: Synthetic peptide
  Seed: GAGDVGKSA (KRAS G13D)
GPGDVGKSG

SEQ ID NO: 12326 - protein, 9 aa, Artificial Sequence
  Description of Artificial Sequence: Synthetic peptide
  Seed: GAGDVGKSA (KRAS G13D)
GPGDVGKSI

SEQ ID NO: 12327 - protein, 9 aa, Artificial Sequence
  Description of Artificial Sequence: Synthetic peptide
  Seed: GAGDVGKSA (KRAS G13D)
GPGDVGKSK

SEQ ID NO: 12328 - protein, 9 aa, Artificial Sequence
  Description of Artificial Sequence: Synthetic peptide
  Seed: GAGDVGKSA (KRAS G13D)
GPGDVGKSL

SEQ ID NO: 12329 - protein, 9 aa, Artificial Sequence
  Description of Artificial Sequence: Synthetic peptide
  Seed: GAGDVGKSA (KRAS G13D)
GPGDVGKSM

SEQ ID NO: 12330 - protein, 9 aa, Artificial Sequence
  Description of Artificial Sequence: Synthetic peptide
  Seed: GAGDVGKSA (KRAS G13D)
GPGDVGKSP

SEQ ID NO: 12331 - protein, 9 aa, Artificial Sequence
  Description of Artificial Sequence: Synthetic peptide
  Seed: GAGDVGKSA (KRAS G13D)
GPGDVGKSR

SEQ ID NO: 12332 - protein, 9 aa, Artificial Sequence
  Description of Artificial Sequence: Synthetic peptide
  Seed: GAGDVGKSA (KRAS G13D)
GPGDVGKSS

SEQ ID NO: 12333 - protein, 9 aa, Artificial Sequence
  Description of Artificial Sequence: Synthetic peptide
  Seed: GAGDVGKSA (KRAS G13D)
GPGDVGKST

SEQ ID NO: 12334 - protein, 9 aa, Artificial Sequence
  Description of Artificial Sequence: Synthetic peptide
  Seed: GAGDVGKSA (KRAS G13D)
GPGDVGKSV

SEQ ID NO: 12335 - protein, 9 aa, Artificial Sequence
  Description of Artificial Sequence: Synthetic peptide
  Seed: GAGDVGKSA (KRAS G13D)
GPGDVGKSY

SEQ ID NO: 12336 - protein, 10 aa, Artificial Sequence
  Description of Artificial Sequence: Synthetic peptide
  Seed: GAGDVGKSAL (KRAS G13D)
GQGDVGKSAF

SEQ ID NO: 12337 - protein, 10 aa, Artificial Sequence
  Description of Artificial Sequence: Synthetic peptide
  Seed: GAGDVGKSAL (KRAS G13D)
GQGDVGKSAH

SEQ ID NO: 12338 - protein, 10 aa, Artificial Sequence
  Description of Artificial Sequence: Synthetic peptide
  Seed: GAGDVGKSAL (KRAS G13D)
GQGDVGKSAI

SEQ ID NO: 12339 - protein, 10 aa, Artificial Sequence
  Description of Artificial Sequence: Synthetic peptide
  Seed: GAGDVGKSAL (KRAS G13D)
GQGDVGKSAK

SEQ ID NO: 12340 - protein, 10 aa, Artificial Sequence
  Description of Artificial Sequence: Synthetic peptide
  Seed: GAGDVGKSAL (KRAS G13D)
GQGDVGKSAL

SEQ ID NO: 12341 - protein, 10 aa, Artificial Sequence
  Description of Artificial Sequence: Synthetic peptide
  Seed: GAGDVGKSAL (KRAS G13D)
GQGDVGKSAM

SEQ ID NO: 12342 - protein, 10 aa, Artificial Sequence
  Description of Artificial Sequence: Synthetic peptide
  Seed: GAGDVGKSAL (KRAS G13D)
GQGDVGKSAR

SEQ ID NO: 12343 - protein, 10 aa, Artificial Sequence
  Description of Artificial Sequence: Synthetic peptide
  Seed: GAGDVGKSAL (KRAS G13D)
GQGDVGKSAW

SEQ ID NO: 12344 - protein, 10 aa, Artificial Sequence
  Description of Artificial Sequence: Synthetic peptide
  Seed: GAGDVGKSAL (KRAS G13D)
GQGDVGKSAY

SEQ ID NO: 12345 - protein, 9 aa, Artificial Sequence
  Description of Artificial Sequence: Synthetic peptide
  Seed: GAGDVGKSA (KRAS G13D)
GQGDVGKSF

SEQ ID NO: 12346 - protein, 9 aa, Artificial Sequence
  Description of Artificial Sequence: Synthetic peptide
  Seed: GAGDVGKSA (KRAS G13D)
GQGDVGKSH

SEQ ID NO: 12347 - protein, 9 aa, Artificial Sequence
  Description of Artificial Sequence: Synthetic peptide
  Seed: GAGDVGKSA (KRAS G13D)
GQGDVGKSK

SEQ ID NO: 12348 - protein, 9 aa, Artificial Sequence
  Description of Artificial Sequence: Synthetic peptide
  Seed: GAGDVGKSA (KRAS G13D)
GQGDVGKSL

SEQ ID NO: 12349 - protein, 9 aa, Artificial Sequence
  Description of Artificial Sequence: Synthetic peptide
  Seed: GAGDVGKSA (KRAS G13D)
GQGDVGKSM

SEQ ID NO: 12350 - protein, 9 aa, Artificial Sequence
  Description of Artificial Sequence: Synthetic peptide
  Seed: GAGDVGKSA (KRAS G13D)
GQGDVGKSR

SEQ ID NO: 12351 - protein, 9 aa, Artificial Sequence
  Description of Artificial Sequence: Synthetic peptide
  Seed: GAGDVGKSA (KRAS G13D)
GQGDVGKSW

SEQ ID NO: 12352 - protein, 9 aa, Artificial Sequence
  Description of Artificial Sequence: Synthetic peptide
  Seed: GAGDVGKSA (KRAS G13D)
GQGDVGKSY

SEQ ID NO: 12353 - protein, 10 aa, Artificial Sequence
  Description of Artificial Sequence: Synthetic peptide
  Seed: GAGDVGKSAL (KRAS G13D)
GRGDVGKSAC

SEQ ID NO: 12354 - protein, 10 aa, Artificial Sequence
  Description of Artificial Sequence: Synthetic peptide
  Seed: GAGDVGKSAL (KRAS G13D)
GRGDVGKSAF

SEQ ID NO: 12355 - protein, 10 aa, Artificial Sequence
  Description of Artificial Sequence: Synthetic peptide
  Seed: GAGDVGKSAL (KRAS G13D)
GRGDVGKSAI

SEQ ID NO: 12356 - protein, 10 aa, Artificial Sequence
  Description of Artificial Sequence: Synthetic peptide
  Seed: GAGDVGKSAL (KRAS G13D)
GRGDVGKSAL

SEQ ID NO: 12357 - protein, 10 aa, Artificial Sequence
  Description of Artificial Sequence: Synthetic peptide
  Seed: GAGDVGKSAL (KRAS G13D)
GRGDVGKSAM

SEQ ID NO: 12358 - protein, 10 aa, Artificial Sequence
  Description of Artificial Sequence: Synthetic peptide
  Seed: GAGDVGKSAL (KRAS G13D)
GRGDVGKSAV

SEQ ID NO: 12359 - protein, 10 aa, Artificial Sequence
  Description of Artificial Sequence: Synthetic peptide
  Seed: GAGDVGKSAL (KRAS G13D)
GRGDVGKSAW

SEQ ID NO: 12360 - protein, 10 aa, Artificial Sequence
  Description of Artificial Sequence: Synthetic peptide
  Seed: GAGDVGKSAL (KRAS G13D)
GRGDVGKSAY

SEQ ID NO: 12361 - protein, 9 aa, Artificial Sequence
  Description of Artificial Sequence: Synthetic peptide
  Seed: GAGDVGKSA (KRAS G13D)
GSGDVGKSA

SEQ ID NO: 12362 - protein, 10 aa, Artificial Sequence
  Description of Artificial Sequence: Synthetic peptide
  Seed: GAGDVGKSAL (KRAS G13D)
GSGDVGKSAF

SEQ ID NO: 12363 - protein, 10 aa, Artificial Sequence
  Description of Artificial Sequence: Synthetic peptide
  Seed: GAGDVGKSAL (KRAS G13D)
GSGDVGKSAH

SEQ ID NO: 12364 - protein, 10 aa, Artificial Sequence
  Description of Artificial Sequence: Synthetic peptide
  Seed: GAGDVGKSAL (KRAS G13D)
GSGDVGKSAI

SEQ ID NO: 12365 - protein, 10 aa, Artificial Sequence
  Description of Artificial Sequence: Synthetic peptide
  Seed: GAGDVGKSAL (KRAS G13D)
GSGDVGKSAK

SEQ ID NO: 12366 - protein, 10 aa, Artificial Sequence
  Description of Artificial Sequence: Synthetic peptide
  Seed: GAGDVGKSAL (KRAS G13D)
GSGDVGKSAL

SEQ ID NO: 12367 - protein, 10 aa, Artificial Sequence
  Description of Artificial Sequence: Synthetic peptide
  Seed: GAGDVGKSAL (KRAS G13D)
GSGDVGKSAM

SEQ ID NO: 12368 - protein, 10 aa, Artificial Sequence
  Description of Artificial Sequence: Synthetic peptide
  Seed: GAGDVGKSAL (KRAS G13D)
GSGDVGKSAR

SEQ ID NO: 12369 - protein, 10 aa, Artificial Sequence
  Description of Artificial Sequence: Synthetic peptide
  Seed: GAGDVGKSAL (KRAS G13D)
GSGDVGKSAV

SEQ ID NO: 12370 - protein, 10 aa, Artificial Sequence
  Description of Artificial Sequence: Synthetic peptide
  Seed: GAGDVGKSAL (KRAS G13D)
GSGDVGKSAW

SEQ ID NO: 12371 - protein, 10 aa, Artificial Sequence
  Description of Artificial Sequence: Synthetic peptide
  Seed: GAGDVGKSAL (KRAS G13D)
GSGDVGKSAY

SEQ ID NO: 12372 - protein, 9 aa, Artificial Sequence
  Description of Artificial Sequence: Synthetic peptide
  Seed: GAGDVGKSA (KRAS G13D)
GSGDVGKSF

SEQ ID NO: 12373 - protein, 9 aa, Artificial Sequence
  Description of Artificial Sequence: Synthetic peptide
  Seed: GAGDVGKSA (KRAS G13D)
GSGDVGKSH

SEQ ID NO: 12374 - protein, 9 aa, Artificial Sequence
  Description of Artificial Sequence: Synthetic peptide
  Seed: GAGDVGKSA (KRAS G13D)
GSGDVGKSI

SEQ ID NO: 12375 - protein, 9 aa, Artificial Sequence
  Description of Artificial Sequence: Synthetic peptide
  Seed: GAGDVGKSA (KRAS G13D)
GSGDVGKSK

SEQ ID NO: 12376 - protein, 9 aa, Artificial Sequence
  Description of Artificial Sequence: Synthetic peptide
  Seed: GAGDVGKSA (KRAS G13D)
GSGDVGKSL

SEQ ID NO: 12377 - protein, 9 aa, Artificial Sequence
  Description of Artificial Sequence: Synthetic peptide
  Seed: GAGDVGKSA (KRAS G13D)
GSGDVGKSM

SEQ ID NO: 12378 - protein, 9 aa, Artificial Sequence
  Description of Artificial Sequence: Synthetic peptide
  Seed: GAGDVGKSA (KRAS G13D)
GSGDVGKSR

SEQ ID NO: 12379 - protein, 9 aa, Artificial Sequence
  Description of Artificial Sequence: Synthetic peptide
  Seed: GAGDVGKSA (KRAS G13D)
GSGDVGKSV

SEQ ID NO: 12380 - protein, 9 aa, Artificial Sequence
  Description of Artificial Sequence: Synthetic peptide
  Seed: GAGDVGKSA (KRAS G13D)
GSGDVGKSW

SEQ ID NO: 12381 - protein, 9 aa, Artificial Sequence
  Description of Artificial Sequence: Synthetic peptide
  Seed: GAGDVGKSA (KRAS G13D)
GSGDVGKSY

SEQ ID NO: 12382 - protein, 9 aa, Artificial Sequence
  Description of Artificial Sequence: Synthetic peptide
  Seed: GAGDVGKSA (KRAS G13D)
GTGDVGKSA

SEQ ID NO: 12383 - protein, 10 aa, Artificial Sequence
  Description of Artificial Sequence: Synthetic peptide
  Seed: GAGDVGKSAL (KRAS G13D)
GTGDVGKSAF

SEQ ID NO: 12384 - protein, 10 aa, Artificial Sequence
  Description of Artificial Sequence: Synthetic peptide
  Seed: GAGDVGKSAL (KRAS G13D)
GTGDVGKSAH

SEQ ID NO: 12385 - protein, 10 aa, Artificial Sequence
  Description of Artificial Sequence: Synthetic peptide
  Seed: GAGDVGKSAL (KRAS G13D)
GTGDVGKSAI

SEQ ID NO: 12386 - protein, 10 aa, Artificial Sequence
  Description of Artificial Sequence: Synthetic peptide
  Seed: GAGDVGKSAL (KRAS G13D)
GTGDVGKSAK

SEQ ID NO: 12387 - protein, 10 aa, Artificial Sequence
  Description of Artificial Sequence: Synthetic peptide
  Seed: GAGDVGKSAL (KRAS G13D)
GTGDVGKSAL

SEQ ID NO: 12388 - protein, 10 aa, Artificial Sequence
  Description of Artificial Sequence: Synthetic peptide
  Seed: GAGDVGKSAL (KRAS G13D)
GTGDVGKSAM

SEQ ID NO: 12389 - protein, 10 aa, Artificial Sequence
  Description of Artificial Sequence: Synthetic peptide
  Seed: GAGDVGKSAL (KRAS G13D)
GTGDVGKSAR

SEQ ID NO: 12390 - protein, 10 aa, Artificial Sequence
  Description of Artificial Sequence: Synthetic peptide
  Seed: GAGDVGKSAL (KRAS G13D)
GTGDVGKSAV

SEQ ID NO: 12391 - protein, 10 aa, Artificial Sequence
  Description of Artificial Sequence: Synthetic peptide
  Seed: GAGDVGKSAL (KRAS G13D)
GTGDVGKSAW

SEQ ID NO: 12392 - protein, 10 aa, Artificial Sequence
  Description of Artificial Sequence: Synthetic peptide
  Seed: GAGDVGKSAL (KRAS G13D)
GTGDVGKSAY

SEQ ID NO: 12393 - protein, 9 aa, Artificial Sequence
  Description of Artificial Sequence: Synthetic peptide
  Seed: GAGDVGKSA (KRAS G13D)
GTGDVGKSF

SEQ ID NO: 12394 - protein, 9 aa, Artificial Sequence
  Description of Artificial Sequence: Synthetic peptide
  Seed: GAGDVGKSA (KRAS G13D)
GTGDVGKSH

SEQ ID NO: 12395 - protein, 9 aa, Artificial Sequence
  Description of Artificial Sequence: Synthetic peptide
  Seed: GAGDVGKSA (KRAS G13D)
GTGDVGKSI

SEQ ID NO: 12396 - protein, 9 aa, Artificial Sequence
  Description of Artificial Sequence: Synthetic peptide
  Seed: GAGDVGKSA (KRAS G13D)
GTGDVGKSK

SEQ ID NO: 12397 - protein, 9 aa, Artificial Sequence
  Description of Artificial Sequence: Synthetic peptide
  Seed: GAGDVGKSA (KRAS G13D)
GTGDVGKSL

SEQ ID NO: 12398 - protein, 9 aa, Artificial Sequence
  Description of Artificial Sequence: Synthetic peptide
  Seed: GAGDVGKSA (KRAS G13D)
GTGDVGKSM

SEQ ID NO: 12399 - protein, 9 aa, Artificial Sequence
  Description of Artificial Sequence: Synthetic peptide
  Seed: GAGDVGKSA (KRAS G13D)
GTGDVGKSR

SEQ ID NO: 12400 - protein, 9 aa, Artificial Sequence
  Description of Artificial Sequence: Synthetic peptide
  Seed: GAGDVGKSA (KRAS G13D)
GTGDVGKSV

SEQ ID NO: 12401 - protein, 9 aa, Artificial Sequence
  Description of Artificial Sequence: Synthetic peptide
  Seed: GAGDVGKSA (KRAS G13D)
GTGDVGKSW

SEQ ID NO: 12402 - protein, 9 aa, Artificial Sequence
  Description of Artificial Sequence: Synthetic peptide
  Seed: GAGDVGKSA (KRAS G13D)
GTGDVGKSY

SEQ ID NO: 12403 - protein, 9 aa, Artificial Sequence
  Description of Artificial Sequence: Synthetic peptide
  Seed: GAGDVGKSA (KRAS G13D)
GVGDVGKSA

SEQ ID NO: 12404 - protein, 10 aa, Artificial Sequence
  Description of Artificial Sequence: Synthetic peptide
  Seed: GAGDVGKSAL (KRAS G13D)
GVGDVGKSAF

SEQ ID NO: 12405 - protein, 10 aa, Artificial Sequence
  Description of Artificial Sequence: Synthetic peptide
  Seed: GAGDVGKSAL (KRAS G13D)
GVGDVGKSAH

SEQ ID NO: 12406 - protein, 10 aa, Artificial Sequence
  Description of Artificial Sequence: Synthetic peptide
  Seed: GAGDVGKSAL (KRAS G13D)
GVGDVGKSAI

SEQ ID NO: 12407 - protein, 10 aa, Artificial Sequence
  Description of Artificial Sequence: Synthetic peptide
  Seed: GAGDVGKSAL (KRAS G13D)
GVGDVGKSAK

SEQ ID NO: 12408 - protein, 10 aa, Artificial Sequence
  Description of Artificial Sequence: Synthetic peptide
  Seed: GAGDVGKSAL (KRAS G13D)
GVGDVGKSAL

SEQ ID NO: 12409 - protein, 10 aa, Artificial Sequence
  Description of Artificial Sequence: Synthetic peptide
  Seed: GAGDVGKSAL (KRAS G13D)
GVGDVGKSAM

SEQ ID NO: 12410 - protein, 10 aa, Artificial Sequence
  Description of Artificial Sequence: Synthetic peptide
  Seed: GAGDVGKSAL (KRAS G13D)
GVGDVGKSAR

SEQ ID NO: 12411 - protein, 10 aa, Artificial Sequence
  Description of Artificial Sequence: Synthetic peptide
  Seed: GAGDVGKSAL (KRAS G13D)
GVGDVGKSAW

SEQ ID NO: 12412 - protein, 10 aa, Artificial Sequence
  Description of Artificial Sequence: Synthetic peptide
  Seed: GAGDVGKSAL (KRAS G13D)
GVGDVGKSAY

SEQ ID NO: 12413 - protein, 9 aa, Artificial Sequence
  Description of Artificial Sequence: Synthetic peptide
  Seed: GAGDVGKSA (KRAS G13D)
GVGDVGKSF

SEQ ID NO: 12414 - protein, 9 aa, Artificial Sequence
  Description of Artificial Sequence: Synthetic peptide
  Seed: GAGDVGKSA (KRAS G13D)
GVGDVGKSH

SEQ ID NO: 12415 - protein, 9 aa, Artificial Sequence
  Description of Artificial Sequence: Synthetic peptide
  Seed: GAGDVGKSA (KRAS G13D)
GVGDVGKSI

SEQ ID NO: 12416 - protein, 9 aa, Artificial Sequence
  Description of Artificial Sequence: Synthetic peptide
  Seed: GAGDVGKSA (KRAS G13D)
GVGDVGKSK

SEQ ID NO: 12417 - protein, 9 aa, Artificial Sequence
  Description of Artificial Sequence: Synthetic peptide
  Seed: GAGDVGKSA (KRAS G13D)
GVGDVGKSL

SEQ ID NO: 12418 - protein, 9 aa, Artificial Sequence
  Description of Artificial Sequence: Synthetic peptide
  Seed: GAGDVGKSA (KRAS G13D)
GVGDVGKSM

SEQ ID NO: 12419 - protein, 9 aa, Artificial Sequence
  Description of Artificial Sequence: Synthetic peptide
  Seed: GAGDVGKSA (KRAS G13D)
GVGDVGKSR

SEQ ID NO: 12420 - protein, 9 aa, Artificial Sequence
  Description of Artificial Sequence: Synthetic peptide
  Seed: GAGDVGKSA (KRAS G13D)
GVGDVGKSV

SEQ ID NO: 12421 - protein, 9 aa, Artificial Sequence
  Description of Artificial Sequence: Synthetic peptide
  Seed: GAGDVGKSA (KRAS G13D)
GVGDVGKSW

SEQ ID NO: 12422 - protein, 9 aa, Artificial Sequence
  Description of Artificial Sequence: Synthetic peptide
  Seed: GAGDVGKSA (KRAS G13D)
GVGDVGKSY

SEQ ID NO: 12423 - protein, 10 aa, Artificial Sequence
  Description of Artificial Sequence: Synthetic peptide
  Seed: GAGDVGKSAL (KRAS G13D)
GWGDVGKSAF

SEQ ID NO: 12424 - protein, 10 aa, Artificial Sequence
  Description of Artificial Sequence: Synthetic peptide
  Seed: GAGDVGKSAL (KRAS G13D)
GWGDVGKSAK

SEQ ID NO: 12425 - protein, 10 aa, Artificial Sequence
  Description of Artificial Sequence: Synthetic peptide
  Seed: GAGDVGKSAL (KRAS G13D)
GWGDVGKSAL

SEQ ID NO: 12426 - protein, 10 aa, Artificial Sequence
  Description of Artificial Sequence: Synthetic peptide
  Seed: GAGDVGKSAL (KRAS G13D)
GWGDVGKSAR

SEQ ID NO: 12427 - protein, 9 aa, Artificial Sequence
  Description of Artificial Sequence: Synthetic peptide
  Seed: GAGDVGKSA (KRAS G13D)
GWGDVGKSK

SEQ ID NO: 12428 - protein, 9 aa, Artificial Sequence
  Description of Artificial Sequence: Synthetic peptide
  Seed: GAGDVGKSA (KRAS G13D)
GWGDVGKSR

SEQ ID NO: 12429 - protein, 9 aa, Artificial Sequence
  Description of Artificial Sequence: Synthetic peptide
  Seed: GAGDVGKSA (KRAS G13D)
GWGDVGKSY

SEQ ID NO: 12430 - protein, 10 aa, Artificial Sequence
  Description of Artificial Sequence: Synthetic peptide
  Seed: GAGDVGKSAL (KRAS G13D)
GYGDVGKSAF

SEQ ID NO: 12431 - protein, 10 aa, Artificial Sequence
  Description of Artificial Sequence: Synthetic peptide
  Seed: GAGDVGKSAL (KRAS G13D)
GYGDVGKSAI

SEQ ID NO: 12432 - protein, 10 aa, Artificial Sequence
  Description of Artificial Sequence: Synthetic peptide
  Seed: GAGDVGKSAL (KRAS G13D)
GYGDVGKSAK

SEQ ID NO: 12433 - protein, 10 aa, Artificial Sequence
  Description of Artificial Sequence: Synthetic peptide
  Seed: GAGDVGKSAL (KRAS G13D)
GYGDVGKSAL

SEQ ID NO: 12434 - protein, 10 aa, Artificial Sequence
  Description of Artificial Sequence: Synthetic peptide
  Seed: GAGDVGKSAL (KRAS G13D)
GYGDVGKSAM

SEQ ID NO: 12435 - protein, 10 aa, Artificial Sequence
  Description of Artificial Sequence: Synthetic peptide
  Seed: GAGDVGKSAL (KRAS G13D)
GYGDVGKSAR

SEQ ID NO: 12436 - protein, 10 aa, Artificial Sequence
  Description of Artificial Sequence: Synthetic peptide
  Seed: GAGDVGKSAL (KRAS G13D)
GYGDVGKSAY

SEQ ID NO: 12437 - protein, 9 aa, Artificial Sequence
  Description of Artificial Sequence: Synthetic peptide
  Seed: GAGDVGKSA (KRAS G13D)
GYGDVGKSK

SEQ ID NO: 12438 - protein, 9 aa, Artificial Sequence
  Description of Artificial Sequence: Synthetic peptide
  Seed: GAGDVGKSA (KRAS G13D)
GYGDVGKSR

SEQ ID NO: 12439 - protein, 9 aa, Artificial Sequence
  Description of Artificial Sequence: Synthetic peptide
  Seed: GAGDVGKSA (KRAS G13D)
GYGDVGKSY

SEQ ID NO: 12440 - protein, 11 aa, Artificial Sequence
  Description of Artificial Sequence: Synthetic peptide
  Seed: LVVVGAGDVGK (KRAS G13D)
LAVVGAGDVGF

SEQ ID NO: 12441 - protein, 11 aa, Artificial Sequence
  Description of Artificial Sequence: Synthetic peptide
  Seed: LVVVGAGDVGK (KRAS G13D)
LAVVGAGDVGH

SEQ ID NO: 12442 - protein, 11 aa, Artificial Sequence
  Description of Artificial Sequence: Synthetic peptide
  Seed: LVVVGAGDVGK (KRAS G13D)
LAVVGAGDVGK

SEQ ID NO: 12443 - protein, 11 aa, Artificial Sequence
  Description of Artificial Sequence: Synthetic peptide
  Seed: LVVVGAGDVGK (KRAS G13D)
LAVVGAGDVGL

SEQ ID NO: 12444 - protein, 11 aa, Artificial Sequence
  Description of Artificial Sequence: Synthetic peptide
  Seed: LVVVGAGDVGK (KRAS G13D)
LAVVGAGDVGM

SEQ ID NO: 12445 - protein, 11 aa, Artificial Sequence
  Description of Artificial Sequence: Synthetic peptide
  Seed: LVVVGAGDVGK (KRAS G13D)
LAVVGAGDVGQ

SEQ ID NO: 12446 - protein, 11 aa, Artificial Sequence
  Description of Artificial Sequence: Synthetic peptide
  Seed: LVVVGAGDVGK (KRAS G13D)
LAVVGAGDVGR

SEQ ID NO: 12447 - protein, 11 aa, Artificial Sequence
  Description of Artificial Sequence: Synthetic peptide
  Seed: LVVVGAGDVGK (KRAS G13D)
LAVVGAGDVGY

SEQ ID NO: 12448 - protein, 11 aa, Artificial Sequence
  Description of Artificial Sequence: Synthetic peptide
  Seed: LVVVGAGDVGK (KRAS G13D)
LCVVGAGDVGK

SEQ ID NO: 12449 - protein, 11 aa, Artificial Sequence
  Description of Artificial Sequence: Synthetic peptide
  Seed: LVVVGAGDVGK (KRAS G13D)
LCVVGAGDVGR

SEQ ID NO: 12450 - protein, 11 aa, Artificial Sequence
  Description of Artificial Sequence: Synthetic peptide
  Seed: LVVVGAGDVGK (KRAS G13D)
LDVVGAGDVGK

SEQ ID NO: 12451 - protein, 11 aa, Artificial Sequence
  Description of Artificial Sequence: Synthetic peptide
  Seed: LVVVGAGDVGK (KRAS G13D)
LDVVGAGDVGR

SEQ ID NO: 12452 - protein, 11 aa, Artificial Sequence
  Description of Artificial Sequence: Synthetic peptide
  Seed: LVVVGAGDVGK (KRAS G13D)
LEVVGAGDVGK

SEQ ID NO: 12453 - protein, 11 aa, Artificial Sequence
  Description of Artificial Sequence: Synthetic peptide
  Seed: LVVVGAGDVGK (KRAS G13D)
LEVVGAGDVGR

SEQ ID NO: 12454 - protein, 11 aa, Artificial Sequence
  Description of Artificial Sequence: Synthetic peptide
  Seed: LVVVGAGDVGK (KRAS G13D)
LFVVGAGDVGK

SEQ ID NO: 12455 - protein, 11 aa, Artificial Sequence
  Description of Artificial Sequence: Synthetic peptide
  Seed: LVVVGAGDVGK (KRAS G13D)
LFVVGAGDVGR

SEQ ID NO: 12456 - protein, 11 aa, Artificial Sequence
  Description of Artificial Sequence: Synthetic peptide
  Seed: LVVVGAGDVGK (KRAS G13D)
LGVVGAGDVGK

SEQ ID NO: 12457 - protein, 11 aa, Artificial Sequence
  Description of Artificial Sequence: Synthetic peptide
  Seed: LVVVGAGDVGK (KRAS G13D)
LGVVGAGDVGQ

SEQ ID NO: 12458 - protein, 11 aa, Artificial Sequence
  Description of Artificial Sequence: Synthetic peptide
  Seed: LVVVGAGDVGK (KRAS G13D)
LGVVGAGDVGR

SEQ ID NO: 12459 - protein, 11 aa, Artificial Sequence
  Description of Artificial Sequence: Synthetic peptide
  Seed: LVVVGAGDVGK (KRAS G13D)
LHVVGAGDVGK

SEQ ID NO: 12460 - protein, 11 aa, Artificial Sequence
  Description of Artificial Sequence: Synthetic peptide
  Seed: LVVVGAGDVGK (KRAS G13D)
LHVVGAGDVGR

SEQ ID NO: 12461 - protein, 9 aa, Artificial Sequence
  Description of Artificial Sequence: Synthetic peptide
  Seed: LVVVGAGDV (KRAS G13D)
LIVVGAGDV

SEQ ID NO: 12462 - protein, 11 aa, Artificial Sequence
  Description of Artificial Sequence: Synthetic peptide
  Seed: LVVVGAGDVGK (KRAS G13D)
LIVVGAGDVGK

SEQ ID NO: 12463 - protein, 11 aa, Artificial Sequence
  Description of Artificial Sequence: Synthetic peptide
  Seed: LVVVGAGDVGK (KRAS G13D)
LIVVGAGDVGR

SEQ ID NO: 12464 - protein, 11 aa, Artificial Sequence
  Description of Artificial Sequence: Synthetic peptide
  Seed: LVVVGAGDVGK (KRAS G13D)
LIVVGAGDVGY

SEQ ID NO: 12465 - protein, 11 aa, Artificial Sequence
  Description of Artificial Sequence: Synthetic peptide
  Seed: LVVVGAGDVGK (KRAS G13D)
LKVVGAGDVGK

SEQ ID NO: 12466 - protein, 9 aa, Artificial Sequence
  Description of Artificial Sequence: Synthetic peptide
  Seed: LVVVGAGDV (KRAS G13D)
LLVVGAGDL

SEQ ID NO: 12467 - protein, 9 aa, Artificial Sequence
  Description of Artificial Sequence: Synthetic peptide
  Seed: LVVVGAGDV (KRAS G13D)
LLVVGAGDV

SEQ ID NO: 12468 - protein, 11 aa, Artificial Sequence
  Description of Artificial Sequence: Synthetic peptide
  Seed: LVVVGAGDVGK (KRAS G13D)
LLVVGAGDVGK

SEQ ID NO: 12469 - protein, 11 aa, Artificial Sequence
  Description of Artificial Sequence: Synthetic peptide
  Seed: LVVVGAGDVGK (KRAS G13D)
LLVVGAGDVGR

SEQ ID NO: 12470 - protein, 9 aa, Artificial Sequence
  Description of Artificial Sequence: Synthetic peptide
  Seed: LVVVGAGDV (KRAS G13D)
LMVVGAGDI

SEQ ID NO: 12471 - protein, 9 aa, Artificial Sequence
  Description of Artificial Sequence: Synthetic peptide
  Seed: LVVVGAGDV (KRAS G13D)
LMVVGAGDL

SEQ ID NO: 12472 - protein, 9 aa, Artificial Sequence
  Description of Artificial Sequence: Synthetic peptide
  Seed: LVVVGAGDV (KRAS G13D)
LMVVGAGDV

SEQ ID NO: 12473 - protein, 11 aa, Artificial Sequence
  Description of Artificial Sequence: Synthetic peptide
  Seed: LVVVGAGDVGK (KRAS G13D)
LMVVGAGDVGK

SEQ ID NO: 12474 - protein, 11 aa, Artificial Sequence
  Description of Artificial Sequence: Synthetic peptide
  Seed: LVVVGAGDVGK (KRAS G13D)
LMVVGAGDVGR

SEQ ID NO: 12475 - protein, 11 aa, Artificial Sequence
  Description of Artificial Sequence: Synthetic peptide
  Seed: LVVVGAGDVGK (KRAS G13D)
LNVVGAGDVGK

SEQ ID NO: 12476 - protein, 11 aa, Artificial Sequence
  Description of Artificial Sequence: Synthetic peptide
  Seed: LVVVGAGDVGK (KRAS G13D)
LNVVGAGDVGR

SEQ ID NO: 12477 - protein, 11 aa, Artificial Sequence
  Description of Artificial Sequence: Synthetic peptide
  Seed: LVVVGAGDVGK (KRAS G13D)
LPVVGAGDVGK

SEQ ID NO: 12478 - protein, 11 aa, Artificial Sequence
  Description of Artificial Sequence: Synthetic peptide
  Seed: LVVVGAGDVGK (KRAS G13D)
LPVVGAGDVGR

SEQ ID NO: 12479 - protein, 11 aa, Artificial Sequence
  Description of Artificial Sequence: Synthetic peptide
  Seed: LVVVGAGDVGK (KRAS G13D)
LQVVGAGDVGK

SEQ ID NO: 12480 - protein, 11 aa, Artificial Sequence
  Description of Artificial Sequence: Synthetic peptide
  Seed: LVVVGAGDVGK (KRAS G13D)
LQVVGAGDVGR

SEQ ID NO: 12481 - protein, 11 aa, Artificial Sequence
  Description of Artificial Sequence: Synthetic peptide
  Seed: LVVVGAGDVGK (KRAS G13D)
LSVVGAGDVGF

SEQ ID NO: 12482 - protein, 11 aa, Artificial Sequence
  Description of Artificial Sequence: Synthetic peptide
  Seed: LVVVGAGDVGK (KRAS G13D)
LSVVGAGDVGK

SEQ ID NO: 12483 - protein, 11 aa, Artificial Sequence
  Description of Artificial Sequence: Synthetic peptide
  Seed: LVVVGAGDVGK (KRAS G13D)
LSVVGAGDVGL

SEQ ID NO: 12484 - protein, 11 aa, Artificial Sequence
  Description of Artificial Sequence: Synthetic peptide
  Seed: LVVVGAGDVGK (KRAS G13D)
LSVVGAGDVGR

SEQ ID NO: 12485 - protein, 11 aa, Artificial Sequence
  Description of Artificial Sequence: Synthetic peptide
  Seed: LVVVGAGDVGK (KRAS G13D)
LSVVGAGDVGY

SEQ ID NO: 12486 - protein, 11 aa, Artificial Sequence
  Description of Artificial Sequence: Synthetic peptide
  Seed: LVVVGAGDVGK (KRAS G13D)
LTVVGAGDVGF

SEQ ID NO: 12487 - protein, 11 aa, Artificial Sequence
  Description of Artificial Sequence: Synthetic peptide
  Seed: LVVVGAGDVGK (KRAS G13D)
LTVVGAGDVGK

SEQ ID NO: 12488 - protein, 11 aa, Artificial Sequence
  Description of Artificial Sequence: Synthetic peptide
  Seed: LVVVGAGDVGK (KRAS G13D)
LTVVGAGDVGL

SEQ ID NO: 12489 - protein, 11 aa, Artificial Sequence
  Description of Artificial Sequence: Synthetic peptide
  Seed: LVVVGAGDVGK (KRAS G13D)
LTVVGAGDVGR

SEQ ID NO: 12490 - protein, 11 aa, Artificial Sequence
  Description of Artificial Sequence: Synthetic peptide
  Seed: LVVVGAGDVGK (KRAS G13D)
LTVVGAGDVGY

SEQ ID NO: 12491 - protein, 11 aa, Artificial Sequence
  Description of Artificial Sequence: Synthetic peptide
  Seed: LVVVGAGDVGK (KRAS G13D)
LVVVGAGDVGL

SEQ ID NO: 12492 - protein, 11 aa, Artificial Sequence
  Description of Artificial Sequence: Synthetic peptide
  Seed: LVVVGAGDVGK (KRAS G13D)
LVVVGAGDVGR

SEQ ID NO: 12493 - protein, 11 aa, Artificial Sequence
  Description of Artificial Sequence: Synthetic peptide
  Seed: LVVVGAGDVGK (KRAS G13D)
LVVVGAGDVGY

SEQ ID NO: 12494 - protein, 11 aa, Artificial Sequence
  Description of Artificial Sequence: Synthetic peptide
  Seed: LVVVGAGDVGK (KRAS G13D)
LWVVGAGDVGK

SEQ ID NO: 12495 - protein, 11 aa, Artificial Sequence
  Description of Artificial Sequence: Synthetic peptide
  Seed: LVVVGAGDVGK (KRAS G13D)
LWVVGAGDVGR

SEQ ID NO: 12496 - protein, 11 aa, Artificial Sequence
  Description of Artificial Sequence: Synthetic peptide
  Seed: LVVVGAGDVGK (KRAS G13D)
LYVVGAGDVGK

SEQ ID NO: 12497 - protein, 11 aa, Artificial Sequence
  Description of Artificial Sequence: Synthetic peptide
  Seed: LVVVGAGDVGK (KRAS G13D)
LYVVGAGDVGR

SEQ ID NO: 12498 - protein, 8 aa, Artificial Sequence
  Description of Artificial Sequence: Synthetic peptide
  Seed: VGAGDVGK (KRAS G13D)
VAAGDVGK

SEQ ID NO: 12499 - protein, 11 aa, Artificial Sequence
  Description of Artificial Sequence: Synthetic peptide
  Seed: VGAGDVGKSAL (KRAS G13D)
VAAGDVGKSAA

SEQ ID NO: 12500 - protein, 11 aa, Artificial Sequence
  Description of Artificial Sequence: Synthetic peptide
  Seed: VGAGDVGKSAL (KRAS G13D)
VAAGDVGKSAF

SEQ ID NO: 12501 - protein, 11 aa, Artificial Sequence
  Description of Artificial Sequence: Synthetic peptide
  Seed: VGAGDVGKSAL (KRAS G13D)
VAAGDVGKSAH

SEQ ID NO: 12502 - protein, 11 aa, Artificial Sequence
  Description of Artificial Sequence: Synthetic peptide
  Seed: VGAGDVGKSAL (KRAS G13D)
VAAGDVGKSAI

SEQ ID NO: 12503 - protein, 11 aa, Artificial Sequence
  Description of Artificial Sequence: Synthetic peptide
  Seed: VGAGDVGKSAL (KRAS G13D)
VAAGDVGKSAK

SEQ ID NO: 12504 - protein, 11 aa, Artificial Sequence
  Description of Artificial Sequence: Synthetic peptide
  Seed: VGAGDVGKSAL (KRAS G13D)
VAAGDVGKSAL

SEQ ID NO: 12505 - protein, 11 aa, Artificial Sequence
  Description of Artificial Sequence: Synthetic peptide
  Seed: VGAGDVGKSAL (KRAS G13D)
VAAGDVGKSAM

SEQ ID NO: 12506 - protein, 11 aa, Artificial Sequence
  Description of Artificial Sequence: Synthetic peptide
  Seed: VGAGDVGKSAL (KRAS G13D)
VAAGDVGKSAR

SEQ ID NO: 12507 - protein, 11 aa, Artificial Sequence
  Description of Artificial Sequence: Synthetic peptide
  Seed: VGAGDVGKSAL (KRAS G13D)
VAAGDVGKSAV

SEQ ID NO: 12508 - protein, 11 aa, Artificial Sequence
  Description of Artificial Sequence: Synthetic peptide
  Seed: VGAGDVGKSAL (KRAS G13D)
VAAGDVGKSAW

SEQ ID NO: 12509 - protein, 11 aa, Artificial Sequence
  Description of Artificial Sequence: Synthetic peptide
  Seed: VGAGDVGKSAL (KRAS G13D)
VAAGDVGKSAY

SEQ ID NO: 12510 - protein, 8 aa, Artificial Sequence
  Description of Artificial Sequence: Synthetic peptide
  Seed: VGAGDVGK (KRAS G13D)
VAAGDVGR

SEQ ID NO: 12511 - protein, 8 aa, Artificial Sequence
  Description of Artificial Sequence: Synthetic peptide
  Seed: VGAGDVGK (KRAS G13D)
VAAGDVGY

SEQ ID NO: 12512 - protein, 9 aa, Artificial Sequence
  Description of Artificial Sequence: Synthetic peptide
  Seed: VVGAGDVGK (KRAS G13D)
VAGAGDVGF

SEQ ID NO: 12513 - protein, 9 aa, Artificial Sequence
  Description of Artificial Sequence: Synthetic peptide
  Seed: VVGAGDVGK (KRAS G13D)
VAGAGDVGH

SEQ ID NO: 12514 - protein, 9 aa, Artificial Sequence
  Description of Artificial Sequence: Synthetic peptide
  Seed: VVGAGDVGK (KRAS G13D)
VAGAGDVGI

SEQ ID NO: 12515 - protein, 9 aa, Artificial Sequence
  Description of Artificial Sequence: Synthetic peptide
  Seed: VVGAGDVGK (KRAS G13D)
VAGAGDVGK

SEQ ID NO: 12516 - protein, 9 aa, Artificial Sequence
  Description of Artificial Sequence: Synthetic peptide
  Seed: VVGAGDVGK (KRAS G13D)
VAGAGDVGL

SEQ ID NO: 12517 - protein, 9 aa, Artificial Sequence
  Description of Artificial Sequence: Synthetic peptide
  Seed: VVGAGDVGK (KRAS G13D)
VAGAGDVGM

SEQ ID NO: 12518 - protein, 9 aa, Artificial Sequence
  Description of Artificial Sequence: Synthetic peptide
  Seed: VVGAGDVGK (KRAS G13D)
VAGAGDVGR

SEQ ID NO: 12519 - protein, 9 aa, Artificial Sequence
  Description of Artificial Sequence: Synthetic peptide
  Seed: VVGAGDVGK (KRAS G13D)
VAGAGDVGV

SEQ ID NO: 12520 - protein, 9 aa, Artificial Sequence
  Description of Artificial Sequence: Synthetic peptide
  Seed: VVGAGDVGK (KRAS G13D)
VAGAGDVGY

SEQ ID NO: 12521 - protein, 10 aa, Artificial Sequence
  Description of Artificial Sequence: Synthetic peptide
  Seed: VVVGAGDVGK (KRAS G13D)
VAVGAGDVGE

SEQ ID NO: 12522 - protein, 10 aa, Artificial Sequence
  Description of Artificial Sequence: Synthetic peptide
  Seed: VVVGAGDVGK (KRAS G13D)
VAVGAGDVGF

SEQ ID NO: 12523 - protein, 10 aa, Artificial Sequence
  Description of Artificial Sequence: Synthetic peptide
  Seed: VVVGAGDVGK (KRAS G13D)
VAVGAGDVGH

SEQ ID NO: 12524 - protein, 10 aa, Artificial Sequence
  Description of Artificial Sequence: Synthetic peptide
  Seed: VVVGAGDVGK (KRAS G13D)
VAVGAGDVGI

SEQ ID NO: 12525 - protein, 10 aa, Artificial Sequence
  Description of Artificial Sequence: Synthetic peptide
  Seed: VVVGAGDVGK (KRAS G13D)
VAVGAGDVGL

SEQ ID NO: 12526 - protein, 10 aa, Artificial Sequence
  Description of Artificial Sequence: Synthetic peptide
  Seed: VVVGAGDVGK (KRAS G13D)
VAVGAGDVGM

SEQ ID NO: 12527 - protein, 10 aa, Artificial Sequence
  Description of Artificial Sequence: Synthetic peptide
  Seed: VVVGAGDVGK (KRAS G13D)
VAVGAGDVGQ

SEQ ID NO: 12528 - protein, 10 aa, Artificial Sequence
  Description of Artificial Sequence: Synthetic peptide
  Seed: VVVGAGDVGK (KRAS G13D)
VAVGAGDVGV

SEQ ID NO: 12529 - protein, 10 aa, Artificial Sequence
  Description of Artificial Sequence: Synthetic peptide
  Seed: VVVGAGDVGK (KRAS G13D)
VAVGAGDVGW

SEQ ID NO: 12530 - protein, 10 aa, Artificial Sequence
  Description of Artificial Sequence: Synthetic peptide
  Seed: VVVGAGDVGK (KRAS G13D)
VAVGAGDVGY

SEQ ID NO: 12531 - protein, 11 aa, Artificial Sequence
  Description of Artificial Sequence: Synthetic peptide
  Seed: VGAGDVGKSAL (KRAS G13D)
VCAGDVGKSAF

SEQ ID NO: 12532 - protein, 11 aa, Artificial Sequence
  Description of Artificial Sequence: Synthetic peptide
  Seed: VGAGDVGKSAL (KRAS G13D)
VCAGDVGKSAK

SEQ ID NO: 12533 - protein, 11 aa, Artificial Sequence
  Description of Artificial Sequence: Synthetic peptide
  Seed: VGAGDVGKSAL (KRAS G13D)
VCAGDVGKSAL

SEQ ID NO: 12534 - protein, 11 aa, Artificial Sequence
  Description of Artificial Sequence: Synthetic peptide
  Seed: VGAGDVGKSAL (KRAS G13D)
VCAGDVGKSAR

SEQ ID NO: 12535 - protein, 11 aa, Artificial Sequence
  Description of Artificial Sequence: Synthetic peptide
  Seed: VGAGDVGKSAL (KRAS G13D)
VCAGDVGKSAW

SEQ ID NO: 12536 - protein, 11 aa, Artificial Sequence
  Description of Artificial Sequence: Synthetic peptide
  Seed: VGAGDVGKSAL (KRAS G13D)
VCAGDVGKSAY

SEQ ID NO: 12537 - protein, 9 aa, Artificial Sequence
  Description of Artificial Sequence: Synthetic peptide
  Seed: VVGAGDVGK (KRAS G13D)
VCGAGDVGK

SEQ ID NO: 12538 - protein, 9 aa, Artificial Sequence
  Description of Artificial Sequence: Synthetic peptide
  Seed: VVGAGDVGK (KRAS G13D)
VCGAGDVGR

SEQ ID NO: 12539 - protein, 10 aa, Artificial Sequence
  Description of Artificial Sequence: Synthetic peptide
  Seed: VVVGAGDVGK (KRAS G13D)
VCVGAGDVGK

SEQ ID NO: 12540 - protein, 10 aa, Artificial Sequence
  Description of Artificial Sequence: Synthetic peptide
  Seed: VVVGAGDVGK (KRAS G13D)
VCVGAGDVGR

SEQ ID NO: 12541 - protein, 10 aa, Artificial Sequence
  Description of Artificial Sequence: Synthetic peptide
  Seed: VVVGAGDVGK (KRAS G13D)
VCVGAGDVGY

SEQ ID NO: 12542 - protein, 8 aa, Artificial Sequence
  Description of Artificial Sequence: Synthetic peptide
  Seed: VGAGDVGK (KRAS G13D)
VDAGDVGK

SEQ ID NO: 12543 - protein, 11 aa, Artificial Sequence
  Description of Artificial Sequence: Synthetic peptide
  Seed: VGAGDVGKSAL (KRAS G13D)
VDAGDVGKSAK

SEQ ID NO: 12544 - protein, 11 aa, Artificial Sequence
  Description of Artificial Sequence: Synthetic peptide
  Seed: VGAGDVGKSAL (KRAS G13D)
VDAGDVGKSAR

SEQ ID NO: 12545 - protein, 11 aa, Artificial Sequence
  Description of Artificial Sequence: Synthetic peptide
  Seed: VGAGDVGKSAL (KRAS G13D)
VDAGDVGKSAW

SEQ ID NO: 12546 - protein, 9 aa, Artificial Sequence
  Description of Artificial Sequence: Synthetic peptide
  Seed: VVGAGDVGK (KRAS G13D)
VDGAGDVGK

SEQ ID NO: 12547 - protein, 9 aa, Artificial Sequence
  Description of Artificial Sequence: Synthetic peptide
  Seed: VVGAGDVGK (KRAS G13D)
VDGAGDVGR

SEQ ID NO: 12548 - protein, 10 aa, Artificial Sequence
  Description of Artificial Sequence: Synthetic peptide
  Seed: VVVGAGDVGK (KRAS G13D)
VDVGAGDVGK

SEQ ID NO: 12549 - protein, 10 aa, Artificial Sequence
  Description of Artificial Sequence: Synthetic peptide
  Seed: VVVGAGDVGK (KRAS G13D)
VDVGAGDVGR

SEQ ID NO: 12550 - protein, 10 aa, Artificial Sequence
  Description of Artificial Sequence: Synthetic peptide
  Seed: VVVGAGDVGK (KRAS G13D)
VDVGAGDVGY

SEQ ID NO: 12551 - protein, 8 aa, Artificial Sequence
  Description of Artificial Sequence: Synthetic peptide
  Seed: VGAGDVGK (KRAS G13D)
VEAGDVGK

SEQ ID NO: 12552 - protein, 11 aa, Artificial Sequence
  Description of Artificial Sequence: Synthetic peptide
  Seed: VGAGDVGKSAL (KRAS G13D)
VEAGDVGKSAF

SEQ ID NO: 12553 - protein, 11 aa, Artificial Sequence
  Description of Artificial Sequence: Synthetic peptide
  Seed: VGAGDVGKSAL (KRAS G13D)
VEAGDVGKSAK

SEQ ID NO: 12554 - protein, 11 aa, Artificial Sequence
  Description of Artificial Sequence: Synthetic peptide
  Seed: VGAGDVGKSAL (KRAS G13D)
VEAGDVGKSAL

SEQ ID NO: 12555 - protein, 11 aa, Artificial Sequence
  Description of Artificial Sequence: Synthetic peptide
  Seed: VGAGDVGKSAL (KRAS G13D)
VEAGDVGKSAM

SEQ ID NO: 12556 - protein, 11 aa, Artificial Sequence
  Description of Artificial Sequence: Synthetic peptide
  Seed: VGAGDVGKSAL (KRAS G13D)
VEAGDVGKSAR

SEQ ID NO: 12557 - protein, 11 aa, Artificial Sequence
  Description of Artificial Sequence: Synthetic peptide
  Seed: VGAGDVGKSAL (KRAS G13D)
VEAGDVGKSAW

SEQ ID NO: 12558 - protein, 11 aa, Artificial Sequence
  Description of Artificial Sequence: Synthetic peptide
  Seed: VGAGDVGKSAL (KRAS G13D)
VEAGDVGKSAY

SEQ ID NO: 12559 - protein, 9 aa, Artificial Sequence
  Description of Artificial Sequence: Synthetic peptide
  Seed: VVGAGDVGK (KRAS G13D)
VEGAGDVGK

SEQ ID NO: 12560 - protein, 9 aa, Artificial Sequence
  Description of Artificial Sequence: Synthetic peptide
  Seed: VVGAGDVGK (KRAS G13D)
VEGAGDVGR

SEQ ID NO: 12561 - protein, 10 aa, Artificial Sequence
  Description of Artificial Sequence: Synthetic peptide
  Seed: VVVGAGDVGK (KRAS G13D)
VEVGAGDVGK

SEQ ID NO: 12562 - protein, 10 aa, Artificial Sequence
  Description of Artificial Sequence: Synthetic peptide
  Seed: VVVGAGDVGK (KRAS G13D)
VEVGAGDVGR

SEQ ID NO: 12563 - protein, 10 aa, Artificial Sequence
  Description of Artificial Sequence: Synthetic peptide
  Seed: VVVGAGDVGK (KRAS G13D)
VEVGAGDVGY

SEQ ID NO: 12564 - protein, 8 aa, Artificial Sequence
  Description of Artificial Sequence: Synthetic peptide
  Seed: VGAGDVGK (KRAS G13D)
VFAGDVGK

SEQ ID NO: 12565 - protein, 11 aa, Artificial Sequence
  Description of Artificial Sequence: Synthetic peptide
  Seed: VGAGDVGKSAL (KRAS G13D)
VFAGDVGKSAF

SEQ ID NO: 12566 - protein, 11 aa, Artificial Sequence
  Description of Artificial Sequence: Synthetic peptide
  Seed: VGAGDVGKSAL (KRAS G13D)
VFAGDVGKSAK

SEQ ID NO: 12567 - protein, 11 aa, Artificial Sequence
  Description of Artificial Sequence: Synthetic peptide
  Seed: VGAGDVGKSAL (KRAS G13D)
VFAGDVGKSAL

SEQ ID NO: 12568 - protein, 11 aa, Artificial Sequence
  Description of Artificial Sequence: Synthetic peptide
  Seed: VGAGDVGKSAL (KRAS G13D)
VFAGDVGKSAR

SEQ ID NO: 12569 - protein, 11 aa, Artificial Sequence
  Description of Artificial Sequence: Synthetic peptide
  Seed: VGAGDVGKSAL (KRAS G13D)
VFAGDVGKSAW

SEQ ID NO: 12570 - protein, 11 aa, Artificial Sequence
  Description of Artificial Sequence: Synthetic peptide
  Seed: VGAGDVGKSAL (KRAS G13D)
VFAGDVGKSAY

SEQ ID NO: 12571 - protein, 8 aa, Artificial Sequence
  Description of Artificial Sequence: Synthetic peptide
  Seed: VGAGDVGK (KRAS G13D)
VFAGDVGR

SEQ ID NO: 12572 - protein, 9 aa, Artificial Sequence
  Description of Artificial Sequence: Synthetic peptide
  Seed: VVGAGDVGK (KRAS G13D)
VFGAGDVGK

SEQ ID NO: 12573 - protein, 9 aa, Artificial Sequence
  Description of Artificial Sequence: Synthetic peptide
  Seed: VVGAGDVGK (KRAS G13D)
VFGAGDVGR

SEQ ID NO: 12574 - protein, 10 aa, Artificial Sequence
  Description of Artificial Sequence: Synthetic peptide
  Seed: VVVGAGDVGK (KRAS G13D)
VFVGAGDVGK

SEQ ID NO: 12575 - protein, 10 aa, Artificial Sequence
  Description of Artificial Sequence: Synthetic peptide
  Seed: VVVGAGDVGK (KRAS G13D)
VFVGAGDVGY

SEQ ID NO: 12576 - protein, 11 aa, Artificial Sequence
  Description of Artificial Sequence: Synthetic peptide
  Seed: VGAGDVGKSAL (KRAS G13D)
VGAGDVGKSAE

SEQ ID NO: 12577 - protein, 11 aa, Artificial Sequence
  Description of Artificial Sequence: Synthetic peptide
  Seed: VGAGDVGKSAL (KRAS G13D)
VGAGDVGKSAF

SEQ ID NO: 12578 - protein, 11 aa, Artificial Sequence
  Description of Artificial Sequence: Synthetic peptide
  Seed: VGAGDVGKSAL (KRAS G13D)
VGAGDVGKSAH

SEQ ID NO: 12579 - protein, 11 aa, Artificial Sequence
  Description of Artificial Sequence: Synthetic peptide
  Seed: VGAGDVGKSAL (KRAS G13D)
VGAGDVGKSAK

SEQ ID NO: 12580 - protein, 11 aa, Artificial Sequence
  Description of Artificial Sequence: Synthetic peptide
  Seed: VGAGDVGKSAL (KRAS G13D)
VGAGDVGKSAM

SEQ ID NO: 12581 - protein, 11 aa, Artificial Sequence
  Description of Artificial Sequence: Synthetic peptide
  Seed: VGAGDVGKSAL (KRAS G13D)
VGAGDVGKSAN

SEQ ID NO: 12582 - protein, 11 aa, Artificial Sequence
  Description of Artificial Sequence: Synthetic peptide
  Seed: VGAGDVGKSAL (KRAS G13D)
VGAGDVGKSAR

SEQ ID NO: 12583 - protein, 11 aa, Artificial Sequence
  Description of Artificial Sequence: Synthetic peptide
  Seed: VGAGDVGKSAL (KRAS G13D)
VGAGDVGKSAW

SEQ ID NO: 12584 - protein, 11 aa, Artificial Sequence
  Description of Artificial Sequence: Synthetic peptide
  Seed: VGAGDVGKSAL (KRAS G13D)
VGAGDVGKSAY

SEQ ID NO: 12585 - protein, 8 aa, Artificial Sequence
  Description of Artificial Sequence: Synthetic peptide
  Seed: VGAGDVGK (KRAS G13D)
VGAGDVGR

SEQ ID NO: 12586 - protein, 9 aa, Artificial Sequence
  Description of Artificial Sequence: Synthetic peptide
  Seed: VVGAGDVGK (KRAS G13D)
VGGAGDVGK

SEQ ID NO: 12587 - protein, 9 aa, Artificial Sequence
  Description of Artificial Sequence: Synthetic peptide
  Seed: VVGAGDVGK (KRAS G13D)
VGGAGDVGR

SEQ ID NO: 12588 - protein, 9 aa, Artificial Sequence
  Description of Artificial Sequence: Synthetic peptide
  Seed: VVGAGDVGK (KRAS G13D)
VGGAGDVGY

SEQ ID NO: 12589 - protein, 10 aa, Artificial Sequence
  Description of Artificial Sequence: Synthetic peptide
  Seed: VVVGAGDVGK (KRAS G13D)
VGVGAGDVGF

SEQ ID NO: 12590 - protein, 10 aa, Artificial Sequence
  Description of Artificial Sequence: Synthetic peptide
  Seed: VVVGAGDVGK (KRAS G13D)
VGVGAGDVGH

SEQ ID NO: 12591 - protein, 10 aa, Artificial Sequence
  Description of Artificial Sequence: Synthetic peptide
  Seed: VVVGAGDVGK (KRAS G13D)
VGVGAGDVGK

SEQ ID NO: 12592 - protein, 10 aa, Artificial Sequence
  Description of Artificial Sequence: Synthetic peptide
  Seed: VVVGAGDVGK (KRAS G13D)
VGVGAGDVGL

SEQ ID NO: 12593 - protein, 10 aa, Artificial Sequence
  Description of Artificial Sequence: Synthetic peptide
  Seed: VVVGAGDVGK (KRAS G13D)
VGVGAGDVGM

SEQ ID NO: 12594 - protein, 10 aa, Artificial Sequence
  Description of Artificial Sequence: Synthetic peptide
  Seed: VVVGAGDVGK (KRAS G13D)
VGVGAGDVGQ

SEQ ID NO: 12595 - protein, 10 aa, Artificial Sequence
  Description of Artificial Sequence: Synthetic peptide
  Seed: VVVGAGDVGK (KRAS G13D)
VGVGAGDVGR

SEQ ID NO: 12596 - protein, 10 aa, Artificial Sequence
  Description of Artificial Sequence: Synthetic peptide
  Seed: VVVGAGDVGK (KRAS G13D)
VGVGAGDVGY

SEQ ID NO: 12597 - protein, 11 aa, Artificial Sequence
  Description of Artificial Sequence: Synthetic peptide
  Seed: VGAGDVGKSAL (KRAS G13D)
VHAGDVGKSAF

SEQ ID NO: 12598 - protein, 11 aa, Artificial Sequence
  Description of Artificial Sequence: Synthetic peptide
  Seed: VGAGDVGKSAL (KRAS G13D)
VHAGDVGKSAK

SEQ ID NO: 12599 - protein, 11 aa, Artificial Sequence
  Description of Artificial Sequence: Synthetic peptide
  Seed: VGAGDVGKSAL (KRAS G13D)
VHAGDVGKSAL

SEQ ID NO: 12600 - protein, 11 aa, Artificial Sequence
  Description of Artificial Sequence: Synthetic peptide
  Seed: VGAGDVGKSAL (KRAS G13D)
VHAGDVGKSAM

SEQ ID NO: 12601 - protein, 11 aa, Artificial Sequence
  Description of Artificial Sequence: Synthetic peptide
  Seed: VGAGDVGKSAL (KRAS G13D)
VHAGDVGKSAW

SEQ ID NO: 12602 - protein, 9 aa, Artificial Sequence
  Description of Artificial Sequence: Synthetic peptide
  Seed: VVGAGDVGK (KRAS G13D)
VHGAGDVGK

SEQ ID NO: 12603 - protein, 10 aa, Artificial Sequence
  Description of Artificial Sequence: Synthetic peptide
  Seed: VVVGAGDVGK (KRAS G13D)
VHVGAGDVGK

SEQ ID NO: 12604 - protein, 10 aa, Artificial Sequence
  Description of Artificial Sequence: Synthetic peptide
  Seed: VVVGAGDVGK (KRAS G13D)
VHVGAGDVGR

SEQ ID NO: 12605 - protein, 8 aa, Artificial Sequence
  Description of Artificial Sequence: Synthetic peptide
  Seed: VGAGDVGK (KRAS G13D)
VIAGDVGK

SEQ ID NO: 12606 - protein, 11 aa, Artificial Sequence
  Description of Artificial Sequence: Synthetic peptide
  Seed: VGAGDVGKSAL (KRAS G13D)
VIAGDVGKSAF

SEQ ID NO: 12607 - protein, 11 aa, Artificial Sequence
  Description of Artificial Sequence: Synthetic peptide
  Seed: VGAGDVGKSAL (KRAS G13D)
VIAGDVGKSAH

SEQ ID NO: 12608 - protein, 11 aa, Artificial Sequence
  Description of Artificial Sequence: Synthetic peptide
  Seed: VGAGDVGKSAL (KRAS G13D)
VIAGDVGKSAK

SEQ ID NO: 12609 - protein, 11 aa, Artificial Sequence
  Description of Artificial Sequence: Synthetic peptide
  Seed: VGAGDVGKSAL (KRAS G13D)
VIAGDVGKSAL

SEQ ID NO: 12610 - protein, 11 aa, Artificial Sequence
  Description of Artificial Sequence: Synthetic peptide
  Seed: VGAGDVGKSAL (KRAS G13D)
VIAGDVGKSAM

SEQ ID NO: 12611 - protein, 11 aa, Artificial Sequence
  Description of Artificial Sequence: Synthetic peptide
  Seed: VGAGDVGKSAL (KRAS G13D)
VIAGDVGKSAR

SEQ ID NO: 12612 - protein, 11 aa, Artificial Sequence
  Description of Artificial Sequence: Synthetic peptide
  Seed: VGAGDVGKSAL (KRAS G13D)
VIAGDVGKSAW

SEQ ID NO: 12613 - protein, 11 aa, Artificial Sequence
  Description of Artificial Sequence: Synthetic peptide
  Seed: VGAGDVGKSAL (KRAS G13D)
VIAGDVGKSAY

SEQ ID NO: 12614 - protein, 8 aa, Artificial Sequence
  Description of Artificial Sequence: Synthetic peptide
  Seed: VGAGDVGK (KRAS G13D)
VIAGDVGR

SEQ ID NO: 12615 - protein, 9 aa, Artificial Sequence
  Description of Artificial Sequence: Synthetic peptide
  Seed: VVGAGDVGK (KRAS G13D)
VIGAGDVGF

SEQ ID NO: 12616 - protein, 9 aa, Artificial Sequence
  Description of Artificial Sequence: Synthetic peptide
  Seed: VVGAGDVGK (KRAS G13D)
VIGAGDVGR

SEQ ID NO: 12617 - protein, 9 aa, Artificial Sequence
  Description of Artificial Sequence: Synthetic peptide
  Seed: VVGAGDVGK (KRAS G13D)
VIGAGDVGY

SEQ ID NO: 12618 - protein, 10 aa, Artificial Sequence
  Description of Artificial Sequence: Synthetic peptide
  Seed: VVVGAGDVGK (KRAS G13D)
VIVGAGDVGF

SEQ ID NO: 12619 - protein, 10 aa, Artificial Sequence
  Description of Artificial Sequence: Synthetic peptide
  Seed: VVVGAGDVGK (KRAS G13D)
VIVGAGDVGL

SEQ ID NO: 12620 - protein, 10 aa, Artificial Sequence
  Description of Artificial Sequence: Synthetic peptide
  Seed: VVVGAGDVGK (KRAS G13D)
VIVGAGDVGM

SEQ ID NO: 12621 - protein, 10 aa, Artificial Sequence
  Description of Artificial Sequence: Synthetic peptide
  Seed: VVVGAGDVGK (KRAS G13D)
VIVGAGDVGQ

SEQ ID NO: 12622 - protein, 10 aa, Artificial Sequence
  Description of Artificial Sequence: Synthetic peptide
  Seed: VVVGAGDVGK (KRAS G13D)
VIVGAGDVGY

SEQ ID NO: 12623 - protein, 11 aa, Artificial Sequence
  Description of Artificial Sequence: Synthetic peptide
  Seed: VGAGDVGKSAL (KRAS G13D)
VKAGDVGKSAW

SEQ ID NO: 12624 - protein, 10 aa, Artificial Sequence
  Description of Artificial Sequence: Synthetic peptide
  Seed: VVVGAGDVGK (KRAS G13D)
VKVGAGDVGK

SEQ ID NO: 12625 - protein, 10 aa, Artificial Sequence
  Description of Artificial Sequence: Synthetic peptide
  Seed: VVVGAGDVGK (KRAS G13D)
VKVGAGDVGR

SEQ ID NO: 12626 - protein, 8 aa, Artificial Sequence
  Description of Artificial Sequence: Synthetic peptide
  Seed: VGAGDVGK (KRAS G13D)
VLAGDVGK

SEQ ID NO: 12627 - protein, 11 aa, Artificial Sequence
  Description of Artificial Sequence: Synthetic peptide
  Seed: VGAGDVGKSAL (KRAS G13D)
VLAGDVGKSAF

SEQ ID NO: 12628 - protein, 11 aa, Artificial Sequence
  Description of Artificial Sequence: Synthetic peptide
  Seed: VGAGDVGKSAL (KRAS G13D)
VLAGDVGKSAH

SEQ ID NO: 12629 - protein, 11 aa, Artificial Sequence
  Description of Artificial Sequence: Synthetic peptide
  Seed: VGAGDVGKSAL (KRAS G13D)
VLAGDVGKSAK

SEQ ID NO: 12630 - protein, 11 aa, Artificial Sequence
  Description of Artificial Sequence: Synthetic peptide
  Seed: VGAGDVGKSAL (KRAS G13D)
VLAGDVGKSAL

SEQ ID NO: 12631 - protein, 11 aa, Artificial Sequence
  Description of Artificial Sequence: Synthetic peptide
  Seed: VGAGDVGKSAL (KRAS G13D)
VLAGDVGKSAM

SEQ ID NO: 12632 - protein, 11 aa, Artificial Sequence
  Description of Artificial Sequence: Synthetic peptide
  Seed: VGAGDVGKSAL (KRAS G13D)
VLAGDVGKSAR

SEQ ID NO: 12633 - protein, 11 aa, Artificial Sequence
  Description of Artificial Sequence: Synthetic peptide
  Seed: VGAGDVGKSAL (KRAS G13D)
VLAGDVGKSAW

SEQ ID NO: 12634 - protein, 11 aa, Artificial Sequence
  Description of Artificial Sequence: Synthetic peptide
  Seed: VGAGDVGKSAL (KRAS G13D)
VLAGDVGKSAY

SEQ ID NO: 12635 - protein, 8 aa, Artificial Sequence
  Description of Artificial Sequence: Synthetic peptide
  Seed: VGAGDVGK (KRAS G13D)
VLAGDVGR

SEQ ID NO: 12636 - protein, 9 aa, Artificial Sequence
  Description of Artificial Sequence: Synthetic peptide
  Seed: VVGAGDVGK (KRAS G13D)
VLGAGDVGR

SEQ ID NO: 12637 - protein, 9 aa, Artificial Sequence
  Description of Artificial Sequence: Synthetic peptide
  Seed: VVGAGDVGK (KRAS G13D)
VLGAGDVGY

SEQ ID NO: 12638 - protein, 10 aa, Artificial Sequence
  Description of Artificial Sequence: Synthetic peptide
  Seed: VVVGAGDVGK (KRAS G13D)
VLVGAGDVGF

SEQ ID NO: 12639 - protein, 10 aa, Artificial Sequence
  Description of Artificial Sequence: Synthetic peptide
  Seed: VVVGAGDVGK (KRAS G13D)
VLVGAGDVGK

SEQ ID NO: 12640 - protein, 10 aa, Artificial Sequence
  Description of Artificial Sequence: Synthetic peptide
  Seed: VVVGAGDVGK (KRAS G13D)
VLVGAGDVGL

SEQ ID NO: 12641 - protein, 10 aa, Artificial Sequence
  Description of Artificial Sequence: Synthetic peptide
  Seed: VVVGAGDVGK (KRAS G13D)
VLVGAGDVGQ

SEQ ID NO: 12642 - protein, 10 aa, Artificial Sequence
  Description of Artificial Sequence: Synthetic peptide
  Seed: VVVGAGDVGK (KRAS G13D)
VLVGAGDVGR

SEQ ID NO: 12643 - protein, 10 aa, Artificial Sequence
  Description of Artificial Sequence: Synthetic peptide
  Seed: VVVGAGDVGK (KRAS G13D)
VLVGAGDVGY

SEQ ID NO: 12644 - protein, 8 aa, Artificial Sequence
  Description of Artificial Sequence: Synthetic peptide
  Seed: VGAGDVGK (KRAS G13D)
VMAGDVGK

SEQ ID NO: 12645 - protein, 11 aa, Artificial Sequence
  Description of Artificial Sequence: Synthetic peptide
  Seed: VGAGDVGKSAL (KRAS G13D)
VMAGDVGKSAF

SEQ ID NO: 12646 - protein, 11 aa, Artificial Sequence
  Description of Artificial Sequence: Synthetic peptide
  Seed: VGAGDVGKSAL (KRAS G13D)
VMAGDVGKSAH

SEQ ID NO: 12647 - protein, 11 aa, Artificial Sequence
  Description of Artificial Sequence: Synthetic peptide
  Seed: VGAGDVGKSAL (KRAS G13D)
VMAGDVGKSAK

SEQ ID NO: 12648 - protein, 11 aa, Artificial Sequence
  Description of Artificial Sequence: Synthetic peptide
  Seed: VGAGDVGKSAL (KRAS G13D)
VMAGDVGKSAL

SEQ ID NO: 12649 - protein, 11 aa, Artificial Sequence
  Description of Artificial Sequence: Synthetic peptide
  Seed: VGAGDVGKSAL (KRAS G13D)
VMAGDVGKSAM

SEQ ID NO: 12650 - protein, 11 aa, Artificial Sequence
  Description of Artificial Sequence: Synthetic peptide
  Seed: VGAGDVGKSAL (KRAS G13D)
VMAGDVGKSAR

SEQ ID NO: 12651 - protein, 11 aa, Artificial Sequence
  Description of Artificial Sequence: Synthetic peptide
  Seed: VGAGDVGKSAL (KRAS G13D)
VMAGDVGKSAW

SEQ ID NO: 12652 - protein, 11 aa, Artificial Sequence
  Description of Artificial Sequence: Synthetic peptide
  Seed: VGAGDVGKSAL (KRAS G13D)
VMAGDVGKSAY

SEQ ID NO: 12653 - protein, 8 aa, Artificial Sequence
  Description of Artificial Sequence: Synthetic peptide
  Seed: VGAGDVGK (KRAS G13D)
VMAGDVGR

SEQ ID NO: 12654 - protein, 9 aa, Artificial Sequence
  Description of Artificial Sequence: Synthetic peptide
  Seed: VVGAGDVGK (KRAS G13D)
VMGAGDVGR

SEQ ID NO: 12655 - protein, 9 aa, Artificial Sequence
  Description of Artificial Sequence: Synthetic peptide
  Seed: VVGAGDVGK (KRAS G13D)
VMGAGDVGY

SEQ ID NO: 12656 - protein, 10 aa, Artificial Sequence
  Description of Artificial Sequence: Synthetic peptide
  Seed: VVVGAGDVGK (KRAS G13D)
VMVGAGDVGF

SEQ ID NO: 12657 - protein, 10 aa, Artificial Sequence
  Description of Artificial Sequence: Synthetic peptide
  Seed: VVVGAGDVGK (KRAS G13D)
VMVGAGDVGL

SEQ ID NO: 12658 - protein, 10 aa, Artificial Sequence
  Description of Artificial Sequence: Synthetic peptide
  Seed: VVVGAGDVGK (KRAS G13D)
VMVGAGDVGM

SEQ ID NO: 12659 - protein, 10 aa, Artificial Sequence
  Description of Artificial Sequence: Synthetic peptide
  Seed: VVVGAGDVGK (KRAS G13D)
VMVGAGDVGQ

SEQ ID NO: 12660 - protein, 10 aa, Artificial Sequence
  Description of Artificial Sequence: Synthetic peptide
  Seed: VVVGAGDVGK (KRAS G13D)
VMVGAGDVGY

SEQ ID NO: 12661 - protein, 8 aa, Artificial Sequence
  Description of Artificial Sequence: Synthetic peptide
  Seed: VGAGDVGK (KRAS G13D)
VNAGDVGK

SEQ ID NO: 12662 - protein, 11 aa, Artificial Sequence
  Description of Artificial Sequence: Synthetic peptide
  Seed: VGAGDVGKSAL (KRAS G13D)
VNAGDVGKSAF

SEQ ID NO: 12663 - protein, 11 aa, Artificial Sequence
  Description of Artificial Sequence: Synthetic peptide
  Seed: VGAGDVGKSAL (KRAS G13D)
VNAGDVGKSAK

SEQ ID NO: 12664 - protein, 11 aa, Artificial Sequence
  Description of Artificial Sequence: Synthetic peptide
  Seed: VGAGDVGKSAL (KRAS G13D)
VNAGDVGKSAL

SEQ ID NO: 12665 - protein, 11 aa, Artificial Sequence
  Description of Artificial Sequence: Synthetic peptide
  Seed: VGAGDVGKSAL (KRAS G13D)
VNAGDVGKSAR

SEQ ID NO: 12666 - protein, 11 aa, Artificial Sequence
  Description of Artificial Sequence: Synthetic peptide
  Seed: VGAGDVGKSAL (KRAS G13D)
VNAGDVGKSAW

SEQ ID NO: 12667 - protein, 11 aa, Artificial Sequence
  Description of Artificial Sequence: Synthetic peptide
  Seed: VGAGDVGKSAL (KRAS G13D)
VNAGDVGKSAY

SEQ ID NO: 12668 - protein, 8 aa, Artificial Sequence
  Description of Artificial Sequence: Synthetic peptide
  Seed: VGAGDVGK (KRAS G13D)
VNAGDVGR

SEQ ID NO: 12669 - protein, 9 aa, Artificial Sequence
  Description of Artificial Sequence: Synthetic peptide
  Seed: VVGAGDVGK (KRAS G13D)
VNGAGDVGK

SEQ ID NO: 12670 - protein, 9 aa, Artificial Sequence
  Description of Artificial Sequence: Synthetic peptide
  Seed: VVGAGDVGK (KRAS G13D)
VNGAGDVGR

SEQ ID NO: 12671 - protein, 9 aa, Artificial Sequence
  Description of Artificial Sequence: Synthetic peptide
  Seed: VVGAGDVGK (KRAS G13D)
VNGAGDVGY

SEQ ID NO: 12672 - protein, 10 aa, Artificial Sequence
  Description of Artificial Sequence: Synthetic peptide
  Seed: VVVGAGDVGK (KRAS G13D)
VNVGAGDVGK

SEQ ID NO: 12673 - protein, 10 aa, Artificial Sequence
  Description of Artificial Sequence: Synthetic peptide
  Seed: VVVGAGDVGK (KRAS G13D)
VNVGAGDVGR

SEQ ID NO: 12674 - protein, 10 aa, Artificial Sequence
  Description of Artificial Sequence: Synthetic peptide
  Seed: VVVGAGDVGK (KRAS G13D)
VNVGAGDVGY

SEQ ID NO: 12675 - protein, 11 aa, Artificial Sequence
  Description of Artificial Sequence: Synthetic peptide
  Seed: VGAGDVGKSAL (KRAS G13D)
VPAGDVGKSAF

SEQ ID NO: 12676 - protein, 11 aa, Artificial Sequence
  Description of Artificial Sequence: Synthetic peptide
  Seed: VGAGDVGKSAL (KRAS G13D)
VPAGDVGKSAI

SEQ ID NO: 12677 - protein, 11 aa, Artificial Sequence
  Description of Artificial Sequence: Synthetic peptide
  Seed: VGAGDVGKSAL (KRAS G13D)
VPAGDVGKSAK

SEQ ID NO: 12678 - protein, 11 aa, Artificial Sequence
  Description of Artificial Sequence: Synthetic peptide
  Seed: VGAGDVGKSAL (KRAS G13D)
VPAGDVGKSAL

SEQ ID NO: 12679 - protein, 11 aa, Artificial Sequence
  Description of Artificial Sequence: Synthetic peptide
  Seed: VGAGDVGKSAL (KRAS G13D)
VPAGDVGKSAM

SEQ ID NO: 12680 - protein, 11 aa, Artificial Sequence
  Description of Artificial Sequence: Synthetic peptide
  Seed: VGAGDVGKSAL (KRAS G13D)
VPAGDVGKSAW

SEQ ID NO: 12681 - protein, 11 aa, Artificial Sequence
  Description of Artificial Sequence: Synthetic peptide
  Seed: VGAGDVGKSAL (KRAS G13D)
VPAGDVGKSAY

SEQ ID NO: 12682 - protein, 9 aa, Artificial Sequence
  Description of Artificial Sequence: Synthetic peptide
  Seed: VVGAGDVGK (KRAS G13D)
VPGAGDVGK

SEQ ID NO: 12683 - protein, 9 aa, Artificial Sequence
  Description of Artificial Sequence: Synthetic peptide
  Seed: VVGAGDVGK (KRAS G13D)
VPGAGDVGR

SEQ ID NO: 12684 - protein, 10 aa, Artificial Sequence
  Description of Artificial Sequence: Synthetic peptide
  Seed: VVVGAGDVGK (KRAS G13D)
VPVGAGDVGK

SEQ ID NO: 12685 - protein, 10 aa, Artificial Sequence
  Description of Artificial Sequence: Synthetic peptide
  Seed: VVVGAGDVGK (KRAS G13D)
VPVGAGDVGR

SEQ ID NO: 12686 - protein, 8 aa, Artificial Sequence
  Description of Artificial Sequence: Synthetic peptide
  Seed: VGAGDVGK (KRAS G13D)
VQAGDVGK

SEQ ID NO: 12687 - protein, 11 aa, Artificial Sequence
  Description of Artificial Sequence: Synthetic peptide
  Seed: VGAGDVGKSAL (KRAS G13D)
VQAGDVGKSAF

SEQ ID NO: 12688 - protein, 11 aa, Artificial Sequence
  Description of Artificial Sequence: Synthetic peptide
  Seed: VGAGDVGKSAL (KRAS G13D)
VQAGDVGKSAH

SEQ ID NO: 12689 - protein, 11 aa, Artificial Sequence
  Description of Artificial Sequence: Synthetic peptide
  Seed: VGAGDVGKSAL (KRAS G13D)
VQAGDVGKSAK

SEQ ID NO: 12690 - protein, 11 aa, Artificial Sequence
  Description of Artificial Sequence: Synthetic peptide
  Seed: VGAGDVGKSAL (KRAS G13D)
VQAGDVGKSAL

SEQ ID NO: 12691 - protein, 11 aa, Artificial Sequence
  Description of Artificial Sequence: Synthetic peptide
  Seed: VGAGDVGKSAL (KRAS G13D)
VQAGDVGKSAM

SEQ ID NO: 12692 - protein, 11 aa, Artificial Sequence
  Description of Artificial Sequence: Synthetic peptide
  Seed: VGAGDVGKSAL (KRAS G13D)
VQAGDVGKSAR

SEQ ID NO: 12693 - protein, 11 aa, Artificial Sequence
  Description of Artificial Sequence: Synthetic peptide
  Seed: VGAGDVGKSAL (KRAS G13D)
VQAGDVGKSAW

SEQ ID NO: 12694 - protein, 11 aa, Artificial Sequence
  Description of Artificial Sequence: Synthetic peptide
  Seed: VGAGDVGKSAL (KRAS G13D)
VQAGDVGKSAY

SEQ ID NO: 12695 - protein, 8 aa, Artificial Sequence
  Description of Artificial Sequence: Synthetic peptide
  Seed: VGAGDVGK (KRAS G13D)
VQAGDVGR

SEQ ID NO: 12696 - protein, 9 aa, Artificial Sequence
  Description of Artificial Sequence: Synthetic peptide
  Seed: VVGAGDVGK (KRAS G13D)
VQGAGDVGK

SEQ ID NO: 12697 - protein, 9 aa, Artificial Sequence
  Description of Artificial Sequence: Synthetic peptide
  Seed: VVGAGDVGK (KRAS G13D)
VQGAGDVGR

SEQ ID NO: 12698 - protein, 9 aa, Artificial Sequence
  Description of Artificial Sequence: Synthetic peptide
  Seed: VVGAGDVGK (KRAS G13D)
VQGAGDVGY

SEQ ID NO: 12699 - protein, 10 aa, Artificial Sequence
  Description of Artificial Sequence: Synthetic peptide
  Seed: VVVGAGDVGK (KRAS G13D)
VQVGAGDVGF

SEQ ID NO: 12700 - protein, 10 aa, Artificial Sequence
  Description of Artificial Sequence: Synthetic peptide
  Seed: VVVGAGDVGK (KRAS G13D)
VQVGAGDVGK

SEQ ID NO: 12701 - protein, 10 aa, Artificial Sequence
  Description of Artificial Sequence: Synthetic peptide
  Seed: VVVGAGDVGK (KRAS G13D)
VQVGAGDVGR

SEQ ID NO: 12702 - protein, 10 aa, Artificial Sequence
  Description of Artificial Sequence: Synthetic peptide
  Seed: VVVGAGDVGK (KRAS G13D)
VQVGAGDVGY

SEQ ID NO: 12703 - protein, 11 aa, Artificial Sequence
  Description of Artificial Sequence: Synthetic peptide
  Seed: VGAGDVGKSAL (KRAS G13D)
VRAGDVGKSAF

SEQ ID NO: 12704 - protein, 11 aa, Artificial Sequence
  Description of Artificial Sequence: Synthetic peptide
  Seed: VGAGDVGKSAL (KRAS G13D)
VRAGDVGKSAH

SEQ ID NO: 12705 - protein, 11 aa, Artificial Sequence
  Description of Artificial Sequence: Synthetic peptide
  Seed: VGAGDVGKSAL (KRAS G13D)
VRAGDVGKSAI

SEQ ID NO: 12706 - protein, 11 aa, Artificial Sequence
  Description of Artificial Sequence: Synthetic peptide
  Seed: VGAGDVGKSAL (KRAS G13D)
VRAGDVGKSAK

SEQ ID NO: 12707 - protein, 11 aa, Artificial Sequence
  Description of Artificial Sequence: Synthetic peptide
  Seed: VGAGDVGKSAL (KRAS G13D)
VRAGDVGKSAL

SEQ ID NO: 12708 - protein, 11 aa, Artificial Sequence
  Description of Artificial Sequence: Synthetic peptide
  Seed: VGAGDVGKSAL (KRAS G13D)
VRAGDVGKSAM

SEQ ID NO: 12709 - protein, 11 aa, Artificial Sequence
  Description of Artificial Sequence: Synthetic peptide
  Seed: VGAGDVGKSAL (KRAS G13D)
VRAGDVGKSAR

SEQ ID NO: 12710 - protein, 11 aa, Artificial Sequence
  Description of Artificial Sequence: Synthetic peptide
  Seed: VGAGDVGKSAL (KRAS G13D)
VRAGDVGKSAV

SEQ ID NO: 12711 - protein, 11 aa, Artificial Sequence
  Description of Artificial Sequence: Synthetic peptide
  Seed: VGAGDVGKSAL (KRAS G13D)
VRAGDVGKSAW

SEQ ID NO: 12712 - protein, 11 aa, Artificial Sequence
  Description of Artificial Sequence: Synthetic peptide
  Seed: VGAGDVGKSAL (KRAS G13D)
VRAGDVGKSAY

SEQ ID NO: 12713 - protein, 10 aa, Artificial Sequence
  Description of Artificial Sequence: Synthetic peptide
  Seed: VVVGAGDVGK (KRAS G13D)
VRVGAGDVGF

SEQ ID NO: 12714 - protein, 10 aa, Artificial Sequence
  Description of Artificial Sequence: Synthetic peptide
  Seed: VVVGAGDVGK (KRAS G13D)
VRVGAGDVGK

SEQ ID NO: 12715 - protein, 10 aa, Artificial Sequence
  Description of Artificial Sequence: Synthetic peptide
  Seed: VVVGAGDVGK (KRAS G13D)
VRVGAGDVGL

SEQ ID NO: 12716 - protein, 10 aa, Artificial Sequence
  Description of Artificial Sequence: Synthetic peptide
  Seed: VVVGAGDVGK (KRAS G13D)
VRVGAGDVGM

SEQ ID NO: 12717 - protein, 10 aa, Artificial Sequence
  Description of Artificial Sequence: Synthetic peptide
  Seed: VVVGAGDVGK (KRAS G13D)
VRVGAGDVGR

SEQ ID NO: 12718 - protein, 10 aa, Artificial Sequence
  Description of Artificial Sequence: Synthetic peptide
  Seed: VVVGAGDVGK (KRAS G13D)
VRVGAGDVGY

SEQ ID NO: 12719 - protein, 8 aa, Artificial Sequence
  Description of Artificial Sequence: Synthetic peptide
  Seed: VGAGDVGK (KRAS G13D)
VSAGDVGK

SEQ ID NO: 12720 - protein, 11 aa, Artificial Sequence
  Description of Artificial Sequence: Synthetic peptide
  Seed: VGAGDVGKSAL (KRAS G13D)
VSAGDVGKSAH

SEQ ID NO: 12721 - protein, 11 aa, Artificial Sequence
  Description of Artificial Sequence: Synthetic peptide
  Seed: VGAGDVGKSAL (KRAS G13D)
VSAGDVGKSAI

SEQ ID NO: 12722 - protein, 11 aa, Artificial Sequence
  Description of Artificial Sequence: Synthetic peptide
  Seed: VGAGDVGKSAL (KRAS G13D)
VSAGDVGKSAK

SEQ ID NO: 12723 - protein, 11 aa, Artificial Sequence
  Description of Artificial Sequence: Synthetic peptide
  Seed: VGAGDVGKSAL (KRAS G13D)
VSAGDVGKSAL

SEQ ID NO: 12724 - protein, 11 aa, Artificial Sequence
  Description of Artificial Sequence: Synthetic peptide
  Seed: VGAGDVGKSAL (KRAS G13D)
VSAGDVGKSAM

SEQ ID NO: 12725 - protein, 11 aa, Artificial Sequence
  Description of Artificial Sequence: Synthetic peptide
  Seed: VGAGDVGKSAL (KRAS G13D)
VSAGDVGKSAR

SEQ ID NO: 12726 - protein, 11 aa, Artificial Sequence
  Description of Artificial Sequence: Synthetic peptide
  Seed: VGAGDVGKSAL (KRAS G13D)
VSAGDVGKSAV

SEQ ID NO: 12727 - protein, 11 aa, Artificial Sequence
  Description of Artificial Sequence: Synthetic peptide
  Seed: VGAGDVGKSAL (KRAS G13D)
VSAGDVGKSAW

SEQ ID NO: 12728 - protein, 11 aa, Artificial Sequence
  Description of Artificial Sequence: Synthetic peptide
  Seed: VGAGDVGKSAL (KRAS G13D)
VSAGDVGKSAY

SEQ ID NO: 12729 - protein, 8 aa, Artificial Sequence
  Description of Artificial Sequence: Synthetic peptide
  Seed: VGAGDVGK (KRAS G13D)
VSAGDVGR

SEQ ID NO: 12730 - protein, 9 aa, Artificial Sequence
  Description of Artificial Sequence: Synthetic peptide
  Seed: VVGAGDVGK (KRAS G13D)
VSGAGDVGF

SEQ ID NO: 12731 - protein, 9 aa, Artificial Sequence
  Description of Artificial Sequence: Synthetic peptide
  Seed: VVGAGDVGK (KRAS G13D)
VSGAGDVGH

SEQ ID NO: 12732 - protein, 9 aa, Artificial Sequence
  Description of Artificial Sequence: Synthetic peptide
  Seed: VVGAGDVGK (KRAS G13D)
VSGAGDVGK

SEQ ID NO: 12733 - protein, 9 aa, Artificial Sequence
  Description of Artificial Sequence: Synthetic peptide
  Seed: VVGAGDVGK (KRAS G13D)
VSGAGDVGL

SEQ ID NO: 12734 - protein, 9 aa, Artificial Sequence
  Description of Artificial Sequence: Synthetic peptide
  Seed: VVGAGDVGK (KRAS G13D)
VSGAGDVGM

SEQ ID NO: 12735 - protein, 9 aa, Artificial Sequence
  Description of Artificial Sequence: Synthetic peptide
  Seed: VVGAGDVGK (KRAS G13D)
VSGAGDVGR

SEQ ID NO: 12736 - protein, 9 aa, Artificial Sequence
  Description of Artificial Sequence: Synthetic peptide
  Seed: VVGAGDVGK (KRAS G13D)
VSGAGDVGY

SEQ ID NO: 12737 - protein, 10 aa, Artificial Sequence
  Description of Artificial Sequence: Synthetic peptide
  Seed: VVVGAGDVGK (KRAS G13D)
VSVGAGDVGF

SEQ ID NO: 12738 - protein, 10 aa, Artificial Sequence
  Description of Artificial Sequence: Synthetic peptide
  Seed: VVVGAGDVGK (KRAS G13D)
VSVGAGDVGH

SEQ ID NO: 12739 - protein, 10 aa, Artificial Sequence
  Description of Artificial Sequence: Synthetic peptide
  Seed: VVVGAGDVGK (KRAS G13D)
VSVGAGDVGL

SEQ ID NO: 12740 - protein, 10 aa, Artificial Sequence
  Description of Artificial Sequence: Synthetic peptide
  Seed: VVVGAGDVGK (KRAS G13D)
VSVGAGDVGM

SEQ ID NO: 12741 - protein, 10 aa, Artificial Sequence
  Description of Artificial Sequence: Synthetic peptide
  Seed: VVVGAGDVGK (KRAS G13D)
VSVGAGDVGQ

SEQ ID NO: 12742 - protein, 10 aa, Artificial Sequence
  Description of Artificial Sequence: Synthetic peptide
  Seed: VVVGAGDVGK (KRAS G13D)
VSVGAGDVGY

SEQ ID NO: 12743 - protein, 8 aa, Artificial Sequence
  Description of Artificial Sequence: Synthetic peptide
  Seed: VGAGDVGK (KRAS G13D)
VTAGDVGK

SEQ ID NO: 12744 - protein, 11 aa, Artificial Sequence
  Description of Artificial Sequence: Synthetic peptide
  Seed: VGAGDVGKSAL (KRAS G13D)
VTAGDVGKSAF

SEQ ID NO: 12745 - protein, 11 aa, Artificial Sequence
  Description of Artificial Sequence: Synthetic peptide
  Seed: VGAGDVGKSAL (KRAS G13D)
VTAGDVGKSAH

SEQ ID NO: 12746 - protein, 11 aa, Artificial Sequence
  Description of Artificial Sequence: Synthetic peptide
  Seed: VGAGDVGKSAL (KRAS G13D)
VTAGDVGKSAI

SEQ ID NO: 12747 - protein, 11 aa, Artificial Sequence
  Description of Artificial Sequence: Synthetic peptide
  Seed: VGAGDVGKSAL (KRAS G13D)
VTAGDVGKSAK

SEQ ID NO: 12748 - protein, 11 aa, Artificial Sequence
  Description of Artificial Sequence: Synthetic peptide
  Seed: VGAGDVGKSAL (KRAS G13D)
VTAGDVGKSAL

SEQ ID NO: 12749 - protein, 11 aa, Artificial Sequence
  Description of Artificial Sequence: Synthetic peptide
  Seed: VGAGDVGKSAL (KRAS G13D)
VTAGDVGKSAM

SEQ ID NO: 12750 - protein, 11 aa, Artificial Sequence
  Description of Artificial Sequence: Synthetic peptide
  Seed: VGAGDVGKSAL (KRAS G13D)
VTAGDVGKSAR

SEQ ID NO: 12751 - protein, 11 aa, Artificial Sequence
  Description of Artificial Sequence: Synthetic peptide
  Seed: VGAGDVGKSAL (KRAS G13D)
VTAGDVGKSAV

SEQ ID NO: 12752 - protein, 11 aa, Artificial Sequence
  Description of Artificial Sequence: Synthetic peptide
  Seed: VGAGDVGKSAL (KRAS G13D)
VTAGDVGKSAW

SEQ ID NO: 12753 - protein, 11 aa, Artificial Sequence
  Description of Artificial Sequence: Synthetic peptide
  Seed: VGAGDVGKSAL (KRAS G13D)
VTAGDVGKSAY

SEQ ID NO: 12754 - protein, 8 aa, Artificial Sequence
  Description of Artificial Sequence: Synthetic peptide
  Seed: VGAGDVGK (KRAS G13D)
VTAGDVGR

SEQ ID NO: 12755 - protein, 9 aa, Artificial Sequence
  Description of Artificial Sequence: Synthetic peptide
  Seed: VVGAGDVGK (KRAS G13D)
VTGAGDVGF

SEQ ID NO: 12756 - protein, 9 aa, Artificial Sequence
  Description of Artificial Sequence: Synthetic peptide
  Seed: VVGAGDVGK (KRAS G13D)
VTGAGDVGL

SEQ ID NO: 12757 - protein, 9 aa, Artificial Sequence
  Description of Artificial Sequence: Synthetic peptide
  Seed: VVGAGDVGK (KRAS G13D)
VTGAGDVGM

SEQ ID NO: 12758 - protein, 9 aa, Artificial Sequence
  Description of Artificial Sequence: Synthetic peptide
  Seed: VVGAGDVGK (KRAS G13D)
VTGAGDVGR

SEQ ID NO: 12759 - protein, 9 aa, Artificial Sequence
  Description of Artificial Sequence: Synthetic peptide
  Seed: VVGAGDVGK (KRAS G13D)
VTGAGDVGY

SEQ ID NO: 12760 - protein, 10 aa, Artificial Sequence
  Description of Artificial Sequence: Synthetic peptide
  Seed: VVVGAGDVGK (KRAS G13D)
VTVGAGDVGF

SEQ ID NO: 12761 - protein, 10 aa, Artificial Sequence
  Description of Artificial Sequence: Synthetic peptide
  Seed: VVVGAGDVGK (KRAS G13D)
VTVGAGDVGH

SEQ ID NO: 12762 - protein, 10 aa, Artificial Sequence
  Description of Artificial Sequence: Synthetic peptide
  Seed: VVVGAGDVGK (KRAS G13D)
VTVGAGDVGL

SEQ ID NO: 12763 - protein, 10 aa, Artificial Sequence
  Description of Artificial Sequence: Synthetic peptide
  Seed: VVVGAGDVGK (KRAS G13D)
VTVGAGDVGM

SEQ ID NO: 12764 - protein, 10 aa, Artificial Sequence
  Description of Artificial Sequence: Synthetic peptide
  Seed: VVVGAGDVGK (KRAS G13D)
VTVGAGDVGQ

SEQ ID NO: 12765 - protein, 10 aa, Artificial Sequence
  Description of Artificial Sequence: Synthetic peptide
  Seed: VVVGAGDVGK (KRAS G13D)
VTVGAGDVGY

SEQ ID NO: 12766 - protein, 8 aa, Artificial Sequence
  Description of Artificial Sequence: Synthetic peptide
  Seed: VGAGDVGK (KRAS G13D)
VVAGDVGK

SEQ ID NO: 12767 - protein, 11 aa, Artificial Sequence
  Description of Artificial Sequence: Synthetic peptide
  Seed: VGAGDVGKSAL (KRAS G13D)
VVAGDVGKSAF

SEQ ID NO: 12768 - protein, 11 aa, Artificial Sequence
  Description of Artificial Sequence: Synthetic peptide
  Seed: VGAGDVGKSAL (KRAS G13D)
VVAGDVGKSAH

SEQ ID NO: 12769 - protein, 11 aa, Artificial Sequence
  Description of Artificial Sequence: Synthetic peptide
  Seed: VGAGDVGKSAL (KRAS G13D)
VVAGDVGKSAI

SEQ ID NO: 12770 - protein, 11 aa, Artificial Sequence
  Description of Artificial Sequence: Synthetic peptide
  Seed: VGAGDVGKSAL (KRAS G13D)
VVAGDVGKSAK

SEQ ID NO: 12771 - protein, 11 aa, Artificial Sequence
  Description of Artificial Sequence: Synthetic peptide
  Seed: VGAGDVGKSAL (KRAS G13D)
VVAGDVGKSAL

SEQ ID NO: 12772 - protein, 11 aa, Artificial Sequence
  Description of Artificial Sequence: Synthetic peptide
  Seed: VGAGDVGKSAL (KRAS G13D)
VVAGDVGKSAM

SEQ ID NO: 12773 - protein, 11 aa, Artificial Sequence
  Description of Artificial Sequence: Synthetic peptide
  Seed: VGAGDVGKSAL (KRAS G13D)
VVAGDVGKSAR

SEQ ID NO: 12774 - protein, 11 aa, Artificial Sequence
  Description of Artificial Sequence: Synthetic peptide
  Seed: VGAGDVGKSAL (KRAS G13D)
VVAGDVGKSAV

SEQ ID NO: 12775 - protein, 11 aa, Artificial Sequence
  Description of Artificial Sequence: Synthetic peptide
  Seed: VGAGDVGKSAL (KRAS G13D)
VVAGDVGKSAY

SEQ ID NO: 12776 - protein, 8 aa, Artificial Sequence
  Description of Artificial Sequence: Synthetic peptide
  Seed: VGAGDVGK (KRAS G13D)
VVAGDVGR

SEQ ID NO: 12777 - protein, 9 aa, Artificial Sequence
  Description of Artificial Sequence: Synthetic peptide
  Seed: VVGAGDVGK (KRAS G13D)
VVGAGDVGF

SEQ ID NO: 12778 - protein, 9 aa, Artificial Sequence
  Description of Artificial Sequence: Synthetic peptide
  Seed: VVGAGDVGK (KRAS G13D)
VVGAGDVGL

SEQ ID NO: 12779 - protein, 9 aa, Artificial Sequence
  Description of Artificial Sequence: Synthetic peptide
  Seed: VVGAGDVGK (KRAS G13D)
VVGAGDVGM

SEQ ID NO: 12780 - protein, 9 aa, Artificial Sequence
  Description of Artificial Sequence: Synthetic peptide
  Seed: VVGAGDVGK (KRAS G13D)
VVGAGDVGR

SEQ ID NO: 12781 - protein, 9 aa, Artificial Sequence
  Description of Artificial Sequence: Synthetic peptide
  Seed: VVGAGDVGK (KRAS G13D)
VVGAGDVGY

SEQ ID NO: 12782 - protein, 10 aa, Artificial Sequence
  Description of Artificial Sequence: Synthetic peptide
  Seed: VVVGAGDVGK (KRAS G13D)
VVVGAGDVGF

SEQ ID NO: 12783 - protein, 10 aa, Artificial Sequence
  Description of Artificial Sequence: Synthetic peptide
  Seed: VVVGAGDVGK (KRAS G13D)
VVVGAGDVGH

SEQ ID NO: 12784 - protein, 10 aa, Artificial Sequence
  Description of Artificial Sequence: Synthetic peptide
  Seed: VVVGAGDVGK (KRAS G13D)
VVVGAGDVGL

SEQ ID NO: 12785 - protein, 10 aa, Artificial Sequence
  Description of Artificial Sequence: Synthetic peptide
  Seed: VVVGAGDVGK (KRAS G13D)
VVVGAGDVGM

SEQ ID NO: 12786 - protein, 10 aa, Artificial Sequence
  Description of Artificial Sequence: Synthetic peptide
  Seed: VVVGAGDVGK (KRAS G13D)
VVVGAGDVGQ

SEQ ID NO: 12787 - protein, 10 aa, Artificial Sequence
  Description of Artificial Sequence: Synthetic peptide
  Seed: VVVGAGDVGK (KRAS G13D)
VVVGAGDVGY

SEQ ID NO: 12788 - protein, 11 aa, Artificial Sequence
  Description of Artificial Sequence: Synthetic peptide
  Seed: VGAGDVGKSAL (KRAS G13D)
VWAGDVGKSAK

SEQ ID NO: 12789 - protein, 11 aa, Artificial Sequence
  Description of Artificial Sequence: Synthetic peptide
  Seed: VGAGDVGKSAL (KRAS G13D)
VWAGDVGKSAR

SEQ ID NO: 12790 - protein, 11 aa, Artificial Sequence
  Description of Artificial Sequence: Synthetic peptide
  Seed: VGAGDVGKSAL (KRAS G13D)
VWAGDVGKSAW

SEQ ID NO: 12791 - protein, 9 aa, Artificial Sequence
  Description of Artificial Sequence: Synthetic peptide
  Seed: VVGAGDVGK (KRAS G13D)
VWGAGDVGK

SEQ ID NO: 12792 - protein, 9 aa, Artificial Sequence
  Description of Artificial Sequence: Synthetic peptide
  Seed: VVGAGDVGK (KRAS G13D)
VWGAGDVGR

SEQ ID NO: 12793 - protein, 10 aa, Artificial Sequence
  Description of Artificial Sequence: Synthetic peptide
  Seed: VVVGAGDVGK (KRAS G13D)
VWVGAGDVGK

SEQ ID NO: 12794 - protein, 10 aa, Artificial Sequence
  Description of Artificial Sequence: Synthetic peptide
  Seed: VVVGAGDVGK (KRAS G13D)
VWVGAGDVGR

SEQ ID NO: 12795 - protein, 11 aa, Artificial Sequence
  Description of Artificial Sequence: Synthetic peptide
  Seed: VGAGDVGKSAL (KRAS G13D)
VYAGDVGKSAK

SEQ ID NO: 12796 - protein, 11 aa, Artificial Sequence
  Description of Artificial Sequence: Synthetic peptide
  Seed: VGAGDVGKSAL (KRAS G13D)
VYAGDVGKSAL

SEQ ID NO: 12797 - protein, 11 aa, Artificial Sequence
  Description of Artificial Sequence: Synthetic peptide
  Seed: VGAGDVGKSAL (KRAS G13D)
VYAGDVGKSAM

SEQ ID NO: 12798 - protein, 11 aa, Artificial Sequence
  Description of Artificial Sequence: Synthetic peptide
  Seed: VGAGDVGKSAL (KRAS G13D)
VYAGDVGKSAW

SEQ ID NO: 12799 - protein, 9 aa, Artificial Sequence
  Description of Artificial Sequence: Synthetic peptide
  Seed: VVGAGDVGK (KRAS G13D)
VYGAGDVGK

SEQ ID NO: 12800 - protein, 9 aa, Artificial Sequence
  Description of Artificial Sequence: Synthetic peptide
  Seed: VVGAGDVGK (KRAS G13D)
VYGAGDVGR

SEQ ID NO: 12801 - protein, 10 aa, Artificial Sequence
  Description of Artificial Sequence: Synthetic peptide
  Seed: VVVGAGDVGK (KRAS G13D)
VYVGAGDVGK

SEQ ID NO: 12802 - protein, 10 aa, Artificial Sequence
  Description of Artificial Sequence: Synthetic peptide
  Seed: VVVGAGDVGK (KRAS G13D)
VYVGAGDVGR

SEQ ID NO: 12803 - protein, 10 aa, Artificial Sequence
  Description of Artificial Sequence: Synthetic peptide
  Seed: VVVGAGDVGK (KRAS G13D)
VYVGAGDVGY

SEQ ID NO: 12804 - protein, 9 aa, Homo sapiens
  Native (KRAS G13D)
AGDVGKSAL

SEQ ID NO: 12805 - protein, 9 aa, Homo sapiens
  Native (KRAS G13D)
VVGAGDVGK

SEQ ID NO: 12806 - protein, 10 aa, Homo sapiens
  Native (KRAS G13D)
VVVGAGDVGK

SEQ ID NO: 12807 - protein, 11 aa, Homo sapiens
  Native (KRAS G13D)
AGDVGKSALTI

SEQ ID NO: 12808 - protein, 9 aa, Homo sapiens
  Native (KRAS G13D)
DVGKSALTI

SEQ ID NO: 12809 - protein, 9 aa, Homo sapiens
  Native (KRAS G13D)
GAGDVGKSA

SEQ ID NO: 12810 - protein, 10 aa, Homo sapiens
  Native (KRAS G13D)
GAGDVGKSAL

SEQ ID NO: 12811 - protein, 9 aa, Homo sapiens
  Native (KRAS G13D)
LVVVGAGDV

SEQ ID NO: 12812 - protein, 11 aa, Homo sapiens
  Native (KRAS G13D)
LVVVGAGDVGK

SEQ ID NO: 12813 - protein, 8 aa, Homo sapiens
  Native (KRAS G13D)
VGAGDVGK

SEQ ID NO: 12814 - protein, 11 aa, Homo sapiens
  Native (KRAS G13D)
VGAGDVGKSAL

SEQ ID NO: 12815 - protein, 10 aa, Artificial Sequence
  Description of Artificial Sequence: Synthetic peptide
  Seed: AGKEEYSAMR (NRAS Q61K)
AAKEEYSAMR

SEQ ID NO: 12816 - protein, 10 aa, Artificial Sequence
  Description of Artificial Sequence: Synthetic peptide
  Seed: AGKEEYSAMR (NRAS Q61K)
AFKEEYSAMK

SEQ ID NO: 12817 - protein, 10 aa, Artificial Sequence
  Description of Artificial Sequence: Synthetic peptide
  Seed: AGKEEYSAMR (NRAS Q61K)
AFKEEYSAMR

SEQ ID NO: 12818 - protein, 10 aa, Artificial Sequence
  Description of Artificial Sequence: Synthetic peptide
  Seed: AGKEEYSAMR (NRAS Q61K)
AIKEEYSAMR

SEQ ID NO: 12819 - protein, 10 aa, Artificial Sequence
  Description of Artificial Sequence: Synthetic peptide
  Seed: AGKEEYSAMR (NRAS Q61K)
ALKEEYSAMR

SEQ ID NO: 12820 - protein, 10 aa, Artificial Sequence
  Description of Artificial Sequence: Synthetic peptide
  Seed: AGKEEYSAMR (NRAS Q61K)
AMKEEYSAMK

SEQ ID NO: 12821 - protein, 10 aa, Artificial Sequence
  Description of Artificial Sequence: Synthetic peptide
  Seed: AGKEEYSAMR (NRAS Q61K)
AMKEEYSAMR

SEQ ID NO: 12822 - protein, 10 aa, Artificial Sequence
  Description of Artificial Sequence: Synthetic peptide
  Seed: AGKEEYSAMR (NRAS Q61K)
AQKEEYSAMR

SEQ ID NO: 12823 - protein, 10 aa, Artificial Sequence
  Description of Artificial Sequence: Synthetic peptide
  Seed: AGKEEYSAMR (NRAS Q61K)
ASKEEYSAMR

SEQ ID NO: 12824 - protein, 10 aa, Artificial Sequence
  Description of Artificial Sequence: Synthetic peptide
  Seed: AGKEEYSAMR (NRAS Q61K)
AVKEEYSAMR

SEQ ID NO: 12825 - protein, 10 aa, Artificial Sequence
  Description of Artificial Sequence: Synthetic peptide
  Seed: AGKEEYSAMR (NRAS Q61K)
AWKEEYSAMK

SEQ ID NO: 12826 - protein, 10 aa, Artificial Sequence
  Description of Artificial Sequence: Synthetic peptide
  Seed: AGKEEYSAMR (NRAS Q61K)
AWKEEYSAMR

SEQ ID NO: 12827 - protein, 10 aa, Artificial Sequence
  Description of Artificial Sequence: Synthetic peptide
  Seed: AGKEEYSAMR (NRAS Q61K)
AYKEEYSAMK

SEQ ID NO: 12828 - protein, 10 aa, Artificial Sequence
  Description of Artificial Sequence: Synthetic peptide
  Seed: AGKEEYSAMR (NRAS Q61K)
AYKEEYSAMR

SEQ ID NO: 12829 - protein, 10 aa, Artificial Sequence
  Description of Artificial Sequence: Synthetic peptide
  Seed: ILDTAGKEEY (NRAS Q61K)
IADTAGKEEY

SEQ ID NO: 12830 - protein, 10 aa, Artificial Sequence
  Description of Artificial Sequence: Synthetic peptide
  Seed: ILDTAGKEEY (NRAS Q61K)
IFDTAGKEEY

SEQ ID NO: 12831 - protein, 10 aa, Artificial Sequence
  Description of Artificial Sequence: Synthetic peptide
  Seed: ILDTAGKEEY (NRAS Q61K)
IIDTAGKEEY

SEQ ID NO: 12832 - protein, 10 aa, Artificial Sequence
  Description of Artificial Sequence: Synthetic peptide
  Seed: ILDTAGKEEY (NRAS Q61K)
IMDTAGKEEY

SEQ ID NO: 12833 - protein, 10 aa, Artificial Sequence
  Description of Artificial Sequence: Synthetic peptide
  Seed: ILDTAGKEEY (NRAS Q61K)
ISDTAGKEEY

SEQ ID NO: 12834 - protein, 10 aa, Artificial Sequence
  Description of Artificial Sequence: Synthetic peptide
  Seed: ILDTAGKEEY (NRAS Q61K)
IVDTAGKEEY

SEQ ID NO: 12835 - protein, 9 aa, Artificial Sequence
  Description of Artificial Sequence: Synthetic peptide
  Seed: AGKEEYSAM (NRAS Q61K)
AAKEEYSAA

SEQ ID NO: 12836 - protein, 9 aa, Artificial Sequence
  Description of Artificial Sequence: Synthetic peptide
  Seed: AGKEEYSAM (NRAS Q61K)
AAKEEYSAC

SEQ ID NO: 12837 - protein, 9 aa, Artificial Sequence
  Description of Artificial Sequence: Synthetic peptide
  Seed: AGKEEYSAM (NRAS Q61K)
AAKEEYSAE

SEQ ID NO: 12838 - protein, 9 aa, Artificial Sequence
  Description of Artificial Sequence: Synthetic peptide
  Seed: AGKEEYSAM (NRAS Q61K)
AAKEEYSAF

SEQ ID NO: 12839 - protein, 9 aa, Artificial Sequence
  Description of Artificial Sequence: Synthetic peptide
  Seed: AGKEEYSAM (NRAS Q61K)
AAKEEYSAG

SEQ ID NO: 12840 - protein, 9 aa, Artificial Sequence
  Description of Artificial Sequence: Synthetic peptide
  Seed: AGKEEYSAM (NRAS Q61K)
AAKEEYSAH

SEQ ID NO: 12841 - protein, 9 aa, Artificial Sequence
  Description of Artificial Sequence: Synthetic peptide
  Seed: AGKEEYSAM (NRAS Q61K)
AAKEEYSAI

SEQ ID NO: 12842 - protein, 9 aa, Artificial Sequence
  Description of Artificial Sequence: Synthetic peptide
  Seed: AGKEEYSAM (NRAS Q61K)
AAKEEYSAK

SEQ ID NO: 12843 - protein, 9 aa, Artificial Sequence
  Description of Artificial Sequence: Synthetic peptide
  Seed: AGKEEYSAM (NRAS Q61K)
AAKEEYSAM

SEQ ID NO: 12844 - protein, 9 aa, Artificial Sequence
  Description of Artificial Sequence: Synthetic peptide
  Seed: AGKEEYSAM (NRAS Q61K)
AAKEEYSAN

SEQ ID NO: 12845 - protein, 9 aa, Artificial Sequence
  Description of Artificial Sequence: Synthetic peptide
  Seed: AGKEEYSAM (NRAS Q61K)
AAKEEYSAP

SEQ ID NO: 12846 - protein, 9 aa, Artificial Sequence
  Description of Artificial Sequence: Synthetic peptide
  Seed: AGKEEYSAM (NRAS Q61K)
AAKEEYSAQ

SEQ ID NO: 12847 - protein, 9 aa, Artificial Sequence
  Description of Artificial Sequence: Synthetic peptide
  Seed: AGKEEYSAM (NRAS Q61K)
AAKEEYSAR

SEQ ID NO: 12848 - protein, 9 aa, Artificial Sequence
  Description of Artificial Sequence: Synthetic peptide
  Seed: AGKEEYSAM (NRAS Q61K)
AAKEEYSAS

SEQ ID NO: 12849 - protein, 9 aa, Artificial Sequence
  Description of Artificial Sequence: Synthetic peptide
  Seed: AGKEEYSAM (NRAS Q61K)
AAKEEYSAT

SEQ ID NO: 12850 - protein, 9 aa, Artificial Sequence
  Description of Artificial Sequence: Synthetic peptide
  Seed: AGKEEYSAM (NRAS Q61K)
AAKEEYSAV

SEQ ID NO: 12851 - protein, 9 aa, Artificial Sequence
  Description of Artificial Sequence: Synthetic peptide
  Seed: AGKEEYSAM (NRAS Q61K)
AAKEEYSAW

SEQ ID NO: 12852 - protein, 9 aa, Artificial Sequence
  Description of Artificial Sequence: Synthetic peptide
  Seed: AGKEEYSAM (NRAS Q61K)
ACKEEYSAF

SEQ ID NO: 12853 - protein, 9 aa, Artificial Sequence
  Description of Artificial Sequence: Synthetic peptide
  Seed: AGKEEYSAM (NRAS Q61K)
ACKEEYSAH

SEQ ID NO: 12854 - protein, 9 aa, Artificial Sequence
  Description of Artificial Sequence: Synthetic peptide
  Seed: AGKEEYSAM (NRAS Q61K)
ACKEEYSAI

SEQ ID NO: 12855 - protein, 9 aa, Artificial Sequence
  Description of Artificial Sequence: Synthetic peptide
  Seed: AGKEEYSAM (NRAS Q61K)
ACKEEYSAL

SEQ ID NO: 12856 - protein, 9 aa, Artificial Sequence
  Description of Artificial Sequence: Synthetic peptide
  Seed: AGKEEYSAM (NRAS Q61K)
ACKEEYSAM

SEQ ID NO: 12857 - protein, 9 aa, Artificial Sequence
  Description of Artificial Sequence: Synthetic peptide
  Seed: AGKEEYSAM (NRAS Q61K)
ACKEEYSAY

SEQ ID NO: 12858 - protein, 9 aa, Artificial Sequence
  Description of Artificial Sequence: Synthetic peptide
  Seed: AGKEEYSAM (NRAS Q61K)
ADKEEYSAF

SEQ ID NO: 12859 - protein, 9 aa, Artificial Sequence
  Description of Artificial Sequence: Synthetic peptide
  Seed: AGKEEYSAM (NRAS Q61K)
ADKEEYSAI

SEQ ID NO: 12860 - protein, 9 aa, Artificial Sequence
  Description of Artificial Sequence: Synthetic peptide
  Seed: AGKEEYSAM (NRAS Q61K)
ADKEEYSAK

SEQ ID NO: 12861 - protein, 9 aa, Artificial Sequence
  Description of Artificial Sequence: Synthetic peptide
  Seed: AGKEEYSAM (NRAS Q61K)
ADKEEYSAL

SEQ ID NO: 12862 - protein, 9 aa, Artificial Sequence
  Description of Artificial Sequence: Synthetic peptide
  Seed: AGKEEYSAM (NRAS Q61K)
ADKEEYSAM

SEQ ID NO: 12863 - protein, 9 aa, Artificial Sequence
  Description of Artificial Sequence: Synthetic peptide
  Seed: AGKEEYSAM (NRAS Q61K)
ADKEEYSAV

SEQ ID NO: 12864 - protein, 9 aa, Artificial Sequence
  Description of Artificial Sequence: Synthetic peptide
  Seed: AGKEEYSAM (NRAS Q61K)
ADKEEYSAY

SEQ ID NO: 12865 - protein, 9 aa, Artificial Sequence
  Description of Artificial Sequence: Synthetic peptide
  Seed: AGKEEYSAM (NRAS Q61K)
AEKEEYSAF

SEQ ID NO: 12866 - protein, 9 aa, Artificial Sequence
  Description of Artificial Sequence: Synthetic peptide
  Seed: AGKEEYSAM (NRAS Q61K)
AEKEEYSAH

SEQ ID NO: 12867 - protein, 9 aa, Artificial Sequence
  Description of Artificial Sequence: Synthetic peptide
  Seed: AGKEEYSAM (NRAS Q61K)
AEKEEYSAI

SEQ ID NO: 12868 - protein, 9 aa, Artificial Sequence
  Description of Artificial Sequence: Synthetic peptide
  Seed: AGKEEYSAM (NRAS Q61K)
AEKEEYSAL

SEQ ID NO: 12869 - protein, 9 aa, Artificial Sequence
  Description of Artificial Sequence: Synthetic peptide
  Seed: AGKEEYSAM (NRAS Q61K)
AEKEEYSAM

SEQ ID NO: 12870 - protein, 9 aa, Artificial Sequence
  Description of Artificial Sequence: Synthetic peptide
  Seed: AGKEEYSAM (NRAS Q61K)
AEKEEYSAV

SEQ ID NO: 12871 - protein, 9 aa, Artificial Sequence
  Description of Artificial Sequence: Synthetic peptide
  Seed: AGKEEYSAM (NRAS Q61K)
AEKEEYSAW

SEQ ID NO: 12872 - protein, 9 aa, Artificial Sequence
  Description of Artificial Sequence: Synthetic peptide
  Seed: AGKEEYSAM (NRAS Q61K)
AEKEEYSAY

SEQ ID NO: 12873 - protein, 9 aa, Artificial Sequence
  Description of Artificial Sequence: Synthetic peptide
  Seed: AGKEEYSAM (NRAS Q61K)
AFKEEYSAF

SEQ ID NO: 12874 - protein, 9 aa, Artificial Sequence
  Description of Artificial Sequence: Synthetic peptide
  Seed: AGKEEYSAM (NRAS Q61K)
AFKEEYSAI

SEQ ID NO: 12875 - protein, 9 aa, Artificial Sequence
  Description of Artificial Sequence: Synthetic peptide
  Seed: AGKEEYSAM (NRAS Q61K)
AFKEEYSAL

SEQ ID NO: 12876 - protein, 9 aa, Artificial Sequence
  Description of Artificial Sequence: Synthetic peptide
  Seed: AGKEEYSAM (NRAS Q61K)
AFKEEYSAM

SEQ ID NO: 12877 - protein, 9 aa, Artificial Sequence
  Description of Artificial Sequence: Synthetic peptide
  Seed: AGKEEYSAM (NRAS Q61K)
AFKEEYSAV

SEQ ID NO: 12878 - protein, 9 aa, Artificial Sequence
  Description of Artificial Sequence: Synthetic peptide
  Seed: AGKEEYSAM (NRAS Q61K)
AFKEEYSAY

SEQ ID NO: 12879 - protein, 9 aa, Artificial Sequence
  Description of Artificial Sequence: Synthetic peptide
  Seed: AGKEEYSAM (NRAS Q61K)
AGKEEYSAA

SEQ ID NO: 12880 - protein, 9 aa, Artificial Sequence
  Description of Artificial Sequence: Synthetic peptide
  Seed: AGKEEYSAM (NRAS Q61K)
AGKEEYSAF

SEQ ID NO: 12881 - protein, 9 aa, Artificial Sequence
  Description of Artificial Sequence: Synthetic peptide
  Seed: AGKEEYSAM (NRAS Q61K)
AGKEEYSAH

SEQ ID NO: 12882 - protein, 9 aa, Artificial Sequence
  Description of Artificial Sequence: Synthetic peptide
  Seed: AGKEEYSAM (NRAS Q61K)
AGKEEYSAI

SEQ ID NO: 12883 - protein, 9 aa, Artificial Sequence
  Description of Artificial Sequence: Synthetic peptide
  Seed: AGKEEYSAM (NRAS Q61K)
AGKEEYSAK

SEQ ID NO: 12884 - protein, 9 aa, Artificial Sequence
  Description of Artificial Sequence: Synthetic peptide
  Seed: AGKEEYSAM (NRAS Q61K)
AGKEEYSAL

SEQ ID NO: 12885 - protein, 9 aa, Artificial Sequence
  Description of Artificial Sequence: Synthetic peptide
  Seed: AGKEEYSAM (NRAS Q61K)
AGKEEYSAV

SEQ ID NO: 12886 - protein, 9 aa, Artificial Sequence
  Description of Artificial Sequence: Synthetic peptide
  Seed: AGKEEYSAM (NRAS Q61K)
AGKEEYSAW

SEQ ID NO: 12887 - protein, 9 aa, Artificial Sequence
  Description of Artificial Sequence: Synthetic peptide
  Seed: AGKEEYSAM (NRAS Q61K)
AGKEEYSAY

SEQ ID NO: 12888 - protein, 9 aa, Artificial Sequence
  Description of Artificial Sequence: Synthetic peptide
  Seed: AGKEEYSAM (NRAS Q61K)
AHKEEYSAF

SEQ ID NO: 12889 - protein, 9 aa, Artificial Sequence
  Description of Artificial Sequence: Synthetic peptide
  Seed: AGKEEYSAM (NRAS Q61K)
AHKEEYSAI

SEQ ID NO: 12890 - protein, 9 aa, Artificial Sequence
  Description of Artificial Sequence: Synthetic peptide
  Seed: AGKEEYSAM (NRAS Q61K)
AHKEEYSAL

SEQ ID NO: 12891 - protein, 9 aa, Artificial Sequence
  Description of Artificial Sequence: Synthetic peptide
  Seed: AGKEEYSAM (NRAS Q61K)
AHKEEYSAM

SEQ ID NO: 12892 - protein, 9 aa, Artificial Sequence
  Description of Artificial Sequence: Synthetic peptide
  Seed: AGKEEYSAM (NRAS Q61K)
AHKEEYSAV

SEQ ID NO: 12893 - protein, 9 aa, Artificial Sequence
  Description of Artificial Sequence: Synthetic peptide
  Seed: AGKEEYSAM (NRAS Q61K)
AHKEEYSAY

SEQ ID NO: 12894 - protein, 9 aa, Artificial Sequence
  Description of Artificial Sequence: Synthetic peptide
  Seed: AGKEEYSAM (NRAS Q61K)
AIKEEYSAA

SEQ ID NO: 12895 - protein, 9 aa, Artificial Sequence
  Description of Artificial Sequence: Synthetic peptide
  Seed: AGKEEYSAM (NRAS Q61K)
AIKEEYSAF

SEQ ID NO: 12896 - protein, 9 aa, Artificial Sequence
  Description of Artificial Sequence: Synthetic peptide
  Seed: AGKEEYSAM (NRAS Q61K)
AIKEEYSAH

SEQ ID NO: 12897 - protein, 9 aa, Artificial Sequence
  Description of Artificial Sequence: Synthetic peptide
  Seed: AGKEEYSAM (NRAS Q61K)
AIKEEYSAI

SEQ ID NO: 12898 - protein, 9 aa, Artificial Sequence
  Description of Artificial Sequence: Synthetic peptide
  Seed: AGKEEYSAM (NRAS Q61K)
AIKEEYSAK

SEQ ID NO: 12899 - protein, 9 aa, Artificial Sequence
  Description of Artificial Sequence: Synthetic peptide
  Seed: AGKEEYSAM (NRAS Q61K)
AIKEEYSAL

SEQ ID NO: 12900 - protein, 9 aa, Artificial Sequence
  Description of Artificial Sequence: Synthetic peptide
  Seed: AGKEEYSAM (NRAS Q61K)
AIKEEYSAM

SEQ ID NO: 12901 - protein, 9 aa, Artificial Sequence
  Description of Artificial Sequence: Synthetic peptide
  Seed: AGKEEYSAM (NRAS Q61K)
AIKEEYSAV

SEQ ID NO: 12902 - protein, 9 aa, Artificial Sequence
  Description of Artificial Sequence: Synthetic peptide
  Seed: AGKEEYSAM (NRAS Q61K)
AIKEEYSAW

SEQ ID NO: 12903 - protein, 9 aa, Artificial Sequence
  Description of Artificial Sequence: Synthetic peptide
  Seed: AGKEEYSAM (NRAS Q61K)
AIKEEYSAY

SEQ ID NO: 12904 - protein, 9 aa, Artificial Sequence
  Description of Artificial Sequence: Synthetic peptide
  Seed: AGKEEYSAM (NRAS Q61K)
AKKEEYSAF

SEQ ID NO: 12905 - protein, 9 aa, Artificial Sequence
  Description of Artificial Sequence: Synthetic peptide
  Seed: AGKEEYSAM (NRAS Q61K)
AKKEEYSAL

SEQ ID NO: 12906 - protein, 9 aa, Artificial Sequence
  Description of Artificial Sequence: Synthetic peptide
  Seed: AGKEEYSAM (NRAS Q61K)
AKKEEYSAM

SEQ ID NO: 12907 - protein, 9 aa, Artificial Sequence
  Description of Artificial Sequence: Synthetic peptide
  Seed: AGKEEYSAM (NRAS Q61K)
AKKEEYSAY

SEQ ID NO: 12908 - protein, 9 aa, Artificial Sequence
  Description of Artificial Sequence: Synthetic peptide
  Seed: AGKEEYSAM (NRAS Q61K)
ALKEEYSAF

SEQ ID NO: 12909 - protein, 9 aa, Artificial Sequence
  Description of Artificial Sequence: Synthetic peptide
  Seed: AGKEEYSAM (NRAS Q61K)
ALKEEYSAH

SEQ ID NO: 12910 - protein, 9 aa, Artificial Sequence
  Description of Artificial Sequence: Synthetic peptide
  Seed: AGKEEYSAM (NRAS Q61K)
ALKEEYSAI

SEQ ID NO: 12911 - protein, 9 aa, Artificial Sequence
  Description of Artificial Sequence: Synthetic peptide
  Seed: AGKEEYSAM (NRAS Q61K)
ALKEEYSAL

SEQ ID NO: 12912 - protein, 9 aa, Artificial Sequence
  Description of Artificial Sequence: Synthetic peptide
  Seed: AGKEEYSAM (NRAS Q61K)
ALKEEYSAM

SEQ ID NO: 12913 - protein, 9 aa, Artificial Sequence
  Description of Artificial Sequence: Synthetic peptide
  Seed: AGKEEYSAM (NRAS Q61K)
ALKEEYSAV

SEQ ID NO: 12914 - protein, 9 aa, Artificial Sequence
  Description of Artificial Sequence: Synthetic peptide
  Seed: AGKEEYSAM (NRAS Q61K)
ALKEEYSAW

SEQ ID NO: 12915 - protein, 9 aa, Artificial Sequence
  Description of Artificial Sequence: Synthetic peptide
  Seed: AGKEEYSAM (NRAS Q61K)
ALKEEYSAY

SEQ ID NO: 12916 - protein, 9 aa, Artificial Sequence
  Description of Artificial Sequence: Synthetic peptide
  Seed: AGKEEYSAM (NRAS Q61K)
AMKEEYSAA

SEQ ID NO: 12917 - protein, 9 aa, Artificial Sequence
  Description of Artificial Sequence: Synthetic peptide
  Seed: AGKEEYSAM (NRAS Q61K)
AMKEEYSAC

SEQ ID NO: 12918 - protein, 9 aa, Artificial Sequence
  Description of Artificial Sequence: Synthetic peptide
  Seed: AGKEEYSAM (NRAS Q61K)
AMKEEYSAF

SEQ ID NO: 12919 - protein, 9 aa, Artificial Sequence
  Description of Artificial Sequence: Synthetic peptide
  Seed: AGKEEYSAM (NRAS Q61K)
AMKEEYSAH

SEQ ID NO: 12920 - protein, 9 aa, Artificial Sequence
  Description of Artificial Sequence: Synthetic peptide
  Seed: AGKEEYSAM (NRAS Q61K)
AMKEEYSAI

SEQ ID NO: 12921 - protein, 9 aa, Artificial Sequence
  Description of Artificial Sequence: Synthetic peptide
  Seed: AGKEEYSAM (NRAS Q61K)
AMKEEYSAL

SEQ ID NO: 12922 - protein, 9 aa, Artificial Sequence
  Description of Artificial Sequence: Synthetic peptide
  Seed: AGKEEYSAM (NRAS Q61K)
AMKEEYSAM

SEQ ID NO: 12923 - protein, 9 aa, Artificial Sequence
  Description of Artificial Sequence: Synthetic peptide
  Seed: AGKEEYSAM (NRAS Q61K)
AMKEEYSAV

SEQ ID NO: 12924 - protein, 9 aa, Artificial Sequence
  Description of Artificial Sequence: Synthetic peptide
  Seed: AGKEEYSAM (NRAS Q61K)
AMKEEYSAW

SEQ ID NO: 12925 - protein, 9 aa, Artificial Sequence
  Description of Artificial Sequence: Synthetic peptide
  Seed: AGKEEYSAM (NRAS Q61K)
AMKEEYSAY

SEQ ID NO: 12926 - protein, 9 aa, Artificial Sequence
  Description of Artificial Sequence: Synthetic peptide
  Seed: AGKEEYSAM (NRAS Q61K)
ANKEEYSAF

SEQ ID NO: 12927 - protein, 9 aa, Artificial Sequence
  Description of Artificial Sequence: Synthetic peptide
  Seed: AGKEEYSAM (NRAS Q61K)
ANKEEYSAH

SEQ ID NO: 12928 - protein, 9 aa, Artificial Sequence
  Description of Artificial Sequence: Synthetic peptide
  Seed: AGKEEYSAM (NRAS Q61K)
ANKEEYSAI

SEQ ID NO: 12929 - protein, 9 aa, Artificial Sequence
  Description of Artificial Sequence: Synthetic peptide
  Seed: AGKEEYSAM (NRAS Q61K)
ANKEEYSAL

SEQ ID NO: 12930 - protein, 9 aa, Artificial Sequence
  Description of Artificial Sequence: Synthetic peptide
  Seed: AGKEEYSAM (NRAS Q61K)
ANKEEYSAM

SEQ ID NO: 12931 - protein, 10 aa, Artificial Sequence
  Description of Artificial Sequence: Synthetic peptide
  Seed: AGKEEYSAMR (NRAS Q61K)
ANKEEYSAMR

SEQ ID NO: 12932 - protein, 9 aa, Artificial Sequence
  Description of Artificial Sequence: Synthetic peptide
  Seed: AGKEEYSAM (NRAS Q61K)
ANKEEYSAV

SEQ ID NO: 12933 - protein, 9 aa, Artificial Sequence
  Description of Artificial Sequence: Synthetic peptide
  Seed: AGKEEYSAM (NRAS Q61K)
ANKEEYSAY

SEQ ID NO: 12934 - protein, 9 aa, Artificial Sequence
  Description of Artificial Sequence: Synthetic peptide
  Seed: AGKEEYSAM (NRAS Q61K)
APKEEYSAA

SEQ ID NO: 12935 - protein, 9 aa, Artificial Sequence
  Description of Artificial Sequence: Synthetic peptide
  Seed: AGKEEYSAM (NRAS Q61K)
APKEEYSAC

SEQ ID NO: 12936 - protein, 9 aa, Artificial Sequence
  Description of Artificial Sequence: Synthetic peptide
  Seed: AGKEEYSAM (NRAS Q61K)
APKEEYSAF

SEQ ID NO: 12937 - protein, 9 aa, Artificial Sequence
  Description of Artificial Sequence: Synthetic peptide
  Seed: AGKEEYSAM (NRAS Q61K)
APKEEYSAG

SEQ ID NO: 12938 - protein, 9 aa, Artificial Sequence
  Description of Artificial Sequence: Synthetic peptide
  Seed: AGKEEYSAM (NRAS Q61K)
APKEEYSAH

SEQ ID NO: 12939 - protein, 9 aa, Artificial Sequence
  Description of Artificial Sequence: Synthetic peptide
  Seed: AGKEEYSAM (NRAS Q61K)
APKEEYSAI

SEQ ID NO: 12940 - protein, 9 aa, Artificial Sequence
  Description of Artificial Sequence: Synthetic peptide
  Seed: AGKEEYSAM (NRAS Q61K)
APKEEYSAK

SEQ ID NO: 12941 - protein, 9 aa, Artificial Sequence
  Description of Artificial Sequence: Synthetic peptide
  Seed: AGKEEYSAM (NRAS Q61K)
APKEEYSAL

SEQ ID NO: 12942 - protein, 9 aa, Artificial Sequence
  Description of Artificial Sequence: Synthetic peptide
  Seed: AGKEEYSAM (NRAS Q61K)
APKEEYSAM

SEQ ID NO: 12943 - protein, 9 aa, Artificial Sequence
  Description of Artificial Sequence: Synthetic peptide
  Seed: AGKEEYSAM (NRAS Q61K)
APKEEYSAP

SEQ ID NO: 12944 - protein, 9 aa, Artificial Sequence
  Description of Artificial Sequence: Synthetic peptide
  Seed: AGKEEYSAM (NRAS Q61K)
APKEEYSAQ

SEQ ID NO: 12945 - protein, 9 aa, Artificial Sequence
  Description of Artificial Sequence: Synthetic peptide
  Seed: AGKEEYSAM (NRAS Q61K)
APKEEYSAR

SEQ ID NO: 12946 - protein, 9 aa, Artificial Sequence
  Description of Artificial Sequence: Synthetic peptide
  Seed: AGKEEYSAM (NRAS Q61K)
APKEEYSAS

SEQ ID NO: 12947 - protein, 9 aa, Artificial Sequence
  Description of Artificial Sequence: Synthetic peptide
  Seed: AGKEEYSAM (NRAS Q61K)
APKEEYSAT

SEQ ID NO: 12948 - protein, 9 aa, Artificial Sequence
  Description of Artificial Sequence: Synthetic peptide
  Seed: AGKEEYSAM (NRAS Q61K)
APKEEYSAV

SEQ ID NO: 12949 - protein, 9 aa, Artificial Sequence
  Description of Artificial Sequence: Synthetic peptide
  Seed: AGKEEYSAM (NRAS Q61K)
APKEEYSAW

SEQ ID NO: 12950 - protein, 9 aa, Artificial Sequence
  Description of Artificial Sequence: Synthetic peptide
  Seed: AGKEEYSAM (NRAS Q61K)
APKEEYSAY

SEQ ID NO: 12951 - protein, 9 aa, Artificial Sequence
  Description of Artificial Sequence: Synthetic peptide
  Seed: AGKEEYSAM (NRAS Q61K)
AQKEEYSAA

SEQ ID NO: 12952 - protein, 9 aa, Artificial Sequence
  Description of Artificial Sequence: Synthetic peptide
  Seed: AGKEEYSAM (NRAS Q61K)
AQKEEYSAC

SEQ ID NO: 12953 - protein, 9 aa, Artificial Sequence
  Description of Artificial Sequence: Synthetic peptide
  Seed: AGKEEYSAM (NRAS Q61K)
AQKEEYSAF

SEQ ID NO: 12954 - protein, 9 aa, Artificial Sequence
  Description of Artificial Sequence: Synthetic peptide
  Seed: AGKEEYSAM (NRAS Q61K)
AQKEEYSAH

SEQ ID NO: 12955 - protein, 9 aa, Artificial Sequence
  Description of Artificial Sequence: Synthetic peptide
  Seed: AGKEEYSAM (NRAS Q61K)
AQKEEYSAI

SEQ ID NO: 12956 - protein, 9 aa, Artificial Sequence
  Description of Artificial Sequence: Synthetic peptide
  Seed: AGKEEYSAM (NRAS Q61K)
AQKEEYSAK

SEQ ID NO: 12957 - protein, 9 aa, Artificial Sequence
  Description of Artificial Sequence: Synthetic peptide
  Seed: AGKEEYSAM (NRAS Q61K)
AQKEEYSAL

SEQ ID NO: 12958 - protein, 9 aa, Artificial Sequence
  Description of Artificial Sequence: Synthetic peptide
  Seed: AGKEEYSAM (NRAS Q61K)
AQKEEYSAM

SEQ ID NO: 12959 - protein, 9 aa, Artificial Sequence
  Description of Artificial Sequence: Synthetic peptide
  Seed: AGKEEYSAM (NRAS Q61K)
AQKEEYSAR

SEQ ID NO: 12960 - protein, 9 aa, Artificial Sequence
  Description of Artificial Sequence: Synthetic peptide
  Seed: AGKEEYSAM (NRAS Q61K)
AQKEEYSAV

SEQ ID NO: 12961 - protein, 9 aa, Artificial Sequence
  Description of Artificial Sequence: Synthetic peptide
  Seed: AGKEEYSAM (NRAS Q61K)
AQKEEYSAW

SEQ ID NO: 12962 - protein, 9 aa, Artificial Sequence
  Description of Artificial Sequence: Synthetic peptide
  Seed: AGKEEYSAM (NRAS Q61K)
AQKEEYSAY

SEQ ID NO: 12963 - protein, 9 aa, Artificial Sequence
  Description of Artificial Sequence: Synthetic peptide
  Seed: AGKEEYSAM (NRAS Q61K)
ARKEEYSAA

SEQ ID NO: 12964 - protein, 9 aa, Artificial Sequence
  Description of Artificial Sequence: Synthetic peptide
  Seed: AGKEEYSAM (NRAS Q61K)
ARKEEYSAC

SEQ ID NO: 12965 - protein, 9 aa, Artificial Sequence
  Description of Artificial Sequence: Synthetic peptide
  Seed: AGKEEYSAM (NRAS Q61K)
ARKEEYSAF

SEQ ID NO: 12966 - protein, 9 aa, Artificial Sequence
  Description of Artificial Sequence: Synthetic peptide
  Seed: AGKEEYSAM (NRAS Q61K)
ARKEEYSAH

SEQ ID NO: 12967 - protein, 9 aa, Artificial Sequence
  Description of Artificial Sequence: Synthetic peptide
  Seed: AGKEEYSAM (NRAS Q61K)
ARKEEYSAI

SEQ ID NO: 12968 - protein, 9 aa, Artificial Sequence
  Description of Artificial Sequence: Synthetic peptide
  Seed: AGKEEYSAM (NRAS Q61K)
ARKEEYSAK

SEQ ID NO: 12969 - protein, 9 aa, Artificial Sequence
  Description of Artificial Sequence: Synthetic peptide
  Seed: AGKEEYSAM (NRAS Q61K)
ARKEEYSAL

SEQ ID NO: 12970 - protein, 9 aa, Artificial Sequence
  Description of Artificial Sequence: Synthetic peptide
  Seed: AGKEEYSAM (NRAS Q61K)
ARKEEYSAM

SEQ ID NO: 12971 - protein, 9 aa, Artificial Sequence
  Description of Artificial Sequence: Synthetic peptide
  Seed: AGKEEYSAM (NRAS Q61K)
ARKEEYSAR

SEQ ID NO: 12972 - protein, 9 aa, Artificial Sequence
  Description of Artificial Sequence: Synthetic peptide
  Seed: AGKEEYSAM (NRAS Q61K)
ARKEEYSAV

SEQ ID NO: 12973 - protein, 9 aa, Artificial Sequence
  Description of Artificial Sequence: Synthetic peptide
  Seed: AGKEEYSAM (NRAS Q61K)
ARKEEYSAW

SEQ ID NO: 12974 - protein, 9 aa, Artificial Sequence
  Description of Artificial Sequence: Synthetic peptide
  Seed: AGKEEYSAM (NRAS Q61K)
ASKEEYSAA

SEQ ID NO: 12975 - protein, 9 aa, Artificial Sequence
  Description of Artificial Sequence: Synthetic peptide
  Seed: AGKEEYSAM (NRAS Q61K)
ASKEEYSAC

SEQ ID NO: 12976 - protein, 9 aa, Artificial Sequence
  Description of Artificial Sequence: Synthetic peptide
  Seed: AGKEEYSAM (NRAS Q61K)
ASKEEYSAF

SEQ ID NO: 12977 - protein, 9 aa, Artificial Sequence
  Description of Artificial Sequence: Synthetic peptide
  Seed: AGKEEYSAM (NRAS Q61K)
ASKEEYSAH

SEQ ID NO: 12978 - protein, 9 aa, Artificial Sequence
  Description of Artificial Sequence: Synthetic peptide
  Seed: AGKEEYSAM (NRAS Q61K)
ASKEEYSAI

SEQ ID NO: 12979 - protein, 9 aa, Artificial Sequence
  Description of Artificial Sequence: Synthetic peptide
  Seed: AGKEEYSAM (NRAS Q61K)
ASKEEYSAK

SEQ ID NO: 12980 - protein, 9 aa, Artificial Sequence
  Description of Artificial Sequence: Synthetic peptide
  Seed: AGKEEYSAM (NRAS Q61K)
ASKEEYSAL

SEQ ID NO: 12981 - protein, 9 aa, Artificial Sequence
  Description of Artificial Sequence: Synthetic peptide
  Seed: AGKEEYSAM (NRAS Q61K)
ASKEEYSAM

SEQ ID NO: 12982 - protein, 9 aa, Artificial Sequence
  Description of Artificial Sequence: Synthetic peptide
  Seed: AGKEEYSAM (NRAS Q61K)
ASKEEYSAQ

SEQ ID NO: 12983 - protein, 9 aa, Artificial Sequence
  Description of Artificial Sequence: Synthetic peptide
  Seed: AGKEEYSAM (NRAS Q61K)
ASKEEYSAR

SEQ ID NO: 12984 - protein, 9 aa, Artificial Sequence
  Description of Artificial Sequence: Synthetic peptide
  Seed: AGKEEYSAM (NRAS Q61K)
ASKEEYSAV

SEQ ID NO: 12985 - protein, 9 aa, Artificial Sequence
  Description of Artificial Sequence: Synthetic peptide
  Seed: AGKEEYSAM (NRAS Q61K)
ASKEEYSAW

SEQ ID NO: 12986 - protein, 9 aa, Artificial Sequence
  Description of Artificial Sequence: Synthetic peptide
  Seed: AGKEEYSAM (NRAS Q61K)
ASKEEYSAY

SEQ ID NO: 12987 - protein, 9 aa, Artificial Sequence
  Description of Artificial Sequence: Synthetic peptide
  Seed: AGKEEYSAM (NRAS Q61K)
ATKEEYSAA

SEQ ID NO: 12988 - protein, 9 aa, Artificial Sequence
  Description of Artificial Sequence: Synthetic peptide
  Seed: AGKEEYSAM (NRAS Q61K)
ATKEEYSAF

SEQ ID NO: 12989 - protein, 9 aa, Artificial Sequence
  Description of Artificial Sequence: Synthetic peptide
  Seed: AGKEEYSAM (NRAS Q61K)
ATKEEYSAH

SEQ ID NO: 12990 - protein, 9 aa, Artificial Sequence
  Description of Artificial Sequence: Synthetic peptide
  Seed: AGKEEYSAM (NRAS Q61K)
ATKEEYSAI

SEQ ID NO: 12991 - protein, 9 aa, Artificial Sequence
  Description of Artificial Sequence: Synthetic peptide
  Seed: AGKEEYSAM (NRAS Q61K)
ATKEEYSAL

SEQ ID NO: 12992 - protein, 9 aa, Artificial Sequence
  Description of Artificial Sequence: Synthetic peptide
  Seed: AGKEEYSAM (NRAS Q61K)
ATKEEYSAM

SEQ ID NO: 12993 - protein, 9 aa, Artificial Sequence
  Description of Artificial Sequence: Synthetic peptide
  Seed: AGKEEYSAM (NRAS Q61K)
ATKEEYSAV

SEQ ID NO: 12994 - protein, 9 aa, Artificial Sequence
  Description of Artificial Sequence: Synthetic peptide
  Seed: AGKEEYSAM (NRAS Q61K)
ATKEEYSAW

SEQ ID NO: 12995 - protein, 9 aa, Artificial Sequence
  Description of Artificial Sequence: Synthetic peptide
  Seed: AGKEEYSAM (NRAS Q61K)
ATKEEYSAY

SEQ ID NO: 12996 - protein, 9 aa, Artificial Sequence
  Description of Artificial Sequence: Synthetic peptide
  Seed: AGKEEYSAM (NRAS Q61K)
AVKEEYSAA

SEQ ID NO: 12997 - protein, 9 aa, Artificial Sequence
  Description of Artificial Sequence: Synthetic peptide
  Seed: AGKEEYSAM (NRAS Q61K)
AVKEEYSAC

SEQ ID NO: 12998 - protein, 9 aa, Artificial Sequence
  Description of Artificial Sequence: Synthetic peptide
  Seed: AGKEEYSAM (NRAS Q61K)
AVKEEYSAF

SEQ ID NO: 12999 - protein, 9 aa, Artificial Sequence
  Description of Artificial Sequence: Synthetic peptide
  Seed: AGKEEYSAM (NRAS Q61K)
AVKEEYSAH

SEQ ID NO: 13000 - protein, 9 aa, Artificial Sequence
  Description of Artificial Sequence: Synthetic peptide
  Seed: AGKEEYSAM (NRAS Q61K)
AVKEEYSAI

SEQ ID NO: 13001 - protein, 9 aa, Artificial Sequence
  Description of Artificial Sequence: Synthetic peptide
  Seed: AGKEEYSAM (NRAS Q61K)
AVKEEYSAK

SEQ ID NO: 13002 - protein, 9 aa, Artificial Sequence
  Description of Artificial Sequence: Synthetic peptide
  Seed: AGKEEYSAM (NRAS Q61K)
AVKEEYSAL

SEQ ID NO: 13003 - protein, 9 aa, Artificial Sequence
  Description of Artificial Sequence: Synthetic peptide
  Seed: AGKEEYSAM (NRAS Q61K)
AVKEEYSAM

SEQ ID NO: 13004 - protein, 9 aa, Artificial Sequence
  Description of Artificial Sequence: Synthetic peptide
  Seed: AGKEEYSAM (NRAS Q61K)
AVKEEYSAR

SEQ ID NO: 13005 - protein, 9 aa, Artificial Sequence
  Description of Artificial Sequence: Synthetic peptide
  Seed: AGKEEYSAM (NRAS Q61K)
AVKEEYSAT

SEQ ID NO: 13006 - protein, 9 aa, Artificial Sequence
  Description of Artificial Sequence: Synthetic peptide
  Seed: AGKEEYSAM (NRAS Q61K)
AVKEEYSAV

SEQ ID NO: 13007 - protein, 9 aa, Artificial Sequence
  Description of Artificial Sequence: Synthetic peptide
  Seed: AGKEEYSAM (NRAS Q61K)
AVKEEYSAW

SEQ ID NO: 13008 - protein, 9 aa, Artificial Sequence
  Description of Artificial Sequence: Synthetic peptide
  Seed: AGKEEYSAM (NRAS Q61K)
AVKEEYSAY

SEQ ID NO: 13009 - protein, 9 aa, Artificial Sequence
  Description of Artificial Sequence: Synthetic peptide
  Seed: AGKEEYSAM (NRAS Q61K)
AWKEEYSAF

SEQ ID NO: 13010 - protein, 9 aa, Artificial Sequence
  Description of Artificial Sequence: Synthetic peptide
  Seed: AGKEEYSAM (NRAS Q61K)
AWKEEYSAL

SEQ ID NO: 13011 - protein, 9 aa, Artificial Sequence
  Description of Artificial Sequence: Synthetic peptide
  Seed: AGKEEYSAM (NRAS Q61K)
AWKEEYSAM

SEQ ID NO: 13012 - protein, 9 aa, Artificial Sequence
  Description of Artificial Sequence: Synthetic peptide
  Seed: AGKEEYSAM (NRAS Q61K)
AWKEEYSAY

SEQ ID NO: 13013 - protein, 9 aa, Artificial Sequence
  Description of Artificial Sequence: Synthetic peptide
  Seed: AGKEEYSAM (NRAS Q61K)
AYKEEYSAF

SEQ ID NO: 13014 - protein, 9 aa, Artificial Sequence
  Description of Artificial Sequence: Synthetic peptide
  Seed: AGKEEYSAM (NRAS Q61K)
AYKEEYSAI

SEQ ID NO: 13015 - protein, 9 aa, Artificial Sequence
  Description of Artificial Sequence: Synthetic peptide
  Seed: AGKEEYSAM (NRAS Q61K)
AYKEEYSAL

SEQ ID NO: 13016 - protein, 9 aa, Artificial Sequence
  Description of Artificial Sequence: Synthetic peptide
  Seed: AGKEEYSAM (NRAS Q61K)
AYKEEYSAM

SEQ ID NO: 13017 - protein, 9 aa, Artificial Sequence
  Description of Artificial Sequence: Synthetic peptide
  Seed: AGKEEYSAM (NRAS Q61K)
AYKEEYSAV

SEQ ID NO: 13018 - protein, 9 aa, Artificial Sequence
  Description of Artificial Sequence: Synthetic peptide
  Seed: AGKEEYSAM (NRAS Q61K)
AYKEEYSAY

SEQ ID NO: 13019 - protein, 11 aa, Artificial Sequence
  Description of Artificial Sequence: Synthetic peptide
  Seed: DTAGKEEYSAM (NRAS Q61K)
DAAGKEEYSAK

SEQ ID NO: 13020 - protein, 11 aa, Artificial Sequence
  Description of Artificial Sequence: Synthetic peptide
  Seed: DTAGKEEYSAM (NRAS Q61K)
DAAGKEEYSAR

SEQ ID NO: 13021 - protein, 11 aa, Artificial Sequence
  Description of Artificial Sequence: Synthetic peptide
  Seed: DILDTAGKEEY (NRAS Q61K)
DALDTAGKEEF

SEQ ID NO: 13022 - protein, 11 aa, Artificial Sequence
  Description of Artificial Sequence: Synthetic peptide
  Seed: DILDTAGKEEY (NRAS Q61K)
DALDTAGKEEK

SEQ ID NO: 13023 - protein, 11 aa, Artificial Sequence
  Description of Artificial Sequence: Synthetic peptide
  Seed: DILDTAGKEEY (NRAS Q61K)
DALDTAGKEER

SEQ ID NO: 13024 - protein, 11 aa, Artificial Sequence
  Description of Artificial Sequence: Synthetic peptide
  Seed: DILDTAGKEEY (NRAS Q61K)
DALDTAGKEEW

SEQ ID NO: 13025 - protein, 11 aa, Artificial Sequence
  Description of Artificial Sequence: Synthetic peptide
  Seed: DILDTAGKEEY (NRAS Q61K)
DALDTAGKEEY

SEQ ID NO: 13026 - protein, 11 aa, Artificial Sequence
  Description of Artificial Sequence: Synthetic peptide
  Seed: DTAGKEEYSAM (NRAS Q61K)
DCAGKEEYSAK

SEQ ID NO: 13027 - protein, 11 aa, Artificial Sequence
  Description of Artificial Sequence: Synthetic peptide
  Seed: DTAGKEEYSAM (NRAS Q61K)
DCAGKEEYSAR

SEQ ID NO: 13028 - protein, 11 aa, Artificial Sequence
  Description of Artificial Sequence: Synthetic peptide
  Seed: DILDTAGKEEY (NRAS Q61K)
DCLDTAGKEEK

SEQ ID NO: 13029 - protein, 11 aa, Artificial Sequence
  Description of Artificial Sequence: Synthetic peptide
  Seed: DILDTAGKEEY (NRAS Q61K)
DCLDTAGKEER

SEQ ID NO: 13030 - protein, 11 aa, Artificial Sequence
  Description of Artificial Sequence: Synthetic peptide
  Seed: DTAGKEEYSAM (NRAS Q61K)
DDAGKEEYSAK

SEQ ID NO: 13031 - protein, 11 aa, Artificial Sequence
  Description of Artificial Sequence: Synthetic peptide
  Seed: DTAGKEEYSAM (NRAS Q61K)
DDAGKEEYSAR

SEQ ID NO: 13032 - protein, 11 aa, Artificial Sequence
  Description of Artificial Sequence: Synthetic peptide
  Seed: DILDTAGKEEY (NRAS Q61K)
DDLDTAGKEEK

SEQ ID NO: 13033 - protein, 11 aa, Artificial Sequence
  Description of Artificial Sequence: Synthetic peptide
  Seed: DILDTAGKEEY (NRAS Q61K)
DDLDTAGKEER

SEQ ID NO: 13034 - protein, 11 aa, Artificial Sequence
  Description of Artificial Sequence: Synthetic peptide
  Seed: DTAGKEEYSAM (NRAS Q61K)
DEAGKEEYSAK

SEQ ID NO: 13035 - protein, 11 aa, Artificial Sequence
  Description of Artificial Sequence: Synthetic peptide
  Seed: DTAGKEEYSAM (NRAS Q61K)
DEAGKEEYSAR

SEQ ID NO: 13036 - protein, 11 aa, Artificial Sequence
  Description of Artificial Sequence: Synthetic peptide
  Seed: DILDTAGKEEY (NRAS Q61K)
DELDTAGKEEF

SEQ ID NO: 13037 - protein, 11 aa, Artificial Sequence
  Description of Artificial Sequence: Synthetic peptide
  Seed: DILDTAGKEEY (NRAS Q61K)
DELDTAGKEEK

SEQ ID NO: 13038 - protein, 11 aa, Artificial Sequence
  Description of Artificial Sequence: Synthetic peptide
  Seed: DILDTAGKEEY (NRAS Q61K)
DELDTAGKEER

SEQ ID NO: 13039 - protein, 11 aa, Artificial Sequence
  Description of Artificial Sequence: Synthetic peptide
  Seed: DILDTAGKEEY (NRAS Q61K)
DELDTAGKEEW

SEQ ID NO: 13040 - protein, 11 aa, Artificial Sequence
  Description of Artificial Sequence: Synthetic peptide
  Seed: DILDTAGKEEY (NRAS Q61K)
DELDTAGKEEY

SEQ ID NO: 13041 - protein, 11 aa, Artificial Sequence
  Description of Artificial Sequence: Synthetic peptide
  Seed: DTAGKEEYSAM (NRAS Q61K)
DFAGKEEYSAK

SEQ ID NO: 13042 - protein, 11 aa, Artificial Sequence
  Description of Artificial Sequence: Synthetic peptide
  Seed: DTAGKEEYSAM (NRAS Q61K)
DFAGKEEYSAR

SEQ ID NO: 13043 - protein, 11 aa, Artificial Sequence
  Description of Artificial Sequence: Synthetic peptide
  Seed: DILDTAGKEEY (NRAS Q61K)
DFLDTAGKEEK

SEQ ID NO: 13044 - protein, 11 aa, Artificial Sequence
  Description of Artificial Sequence: Synthetic peptide
  Seed: DILDTAGKEEY (NRAS Q61K)
DFLDTAGKEER

SEQ ID NO: 13045 - protein, 11 aa, Artificial Sequence
  Description of Artificial Sequence: Synthetic peptide
  Seed: DILDTAGKEEY (NRAS Q61K)
DFLDTAGKEEY

SEQ ID NO: 13046 - protein, 11 aa, Artificial Sequence
  Description of Artificial Sequence: Synthetic peptide
  Seed: DTAGKEEYSAM (NRAS Q61K)
DGAGKEEYSAK

SEQ ID NO: 13047 - protein, 11 aa, Artificial Sequence
  Description of Artificial Sequence: Synthetic peptide
  Seed: DTAGKEEYSAM (NRAS Q61K)
DGAGKEEYSAR

SEQ ID NO: 13048 - protein, 11 aa, Artificial Sequence
  Description of Artificial Sequence: Synthetic peptide
  Seed: DILDTAGKEEY (NRAS Q61K)
DGLDTAGKEEF

SEQ ID NO: 13049 - protein, 11 aa, Artificial Sequence
  Description of Artificial Sequence: Synthetic peptide
  Seed: DILDTAGKEEY (NRAS Q61K)
DGLDTAGKEEK

SEQ ID NO: 13050 - protein, 11 aa, Artificial Sequence
  Description of Artificial Sequence: Synthetic peptide
  Seed: DILDTAGKEEY (NRAS Q61K)
DGLDTAGKEER

SEQ ID NO: 13051 - protein, 11 aa, Artificial Sequence
  Description of Artificial Sequence: Synthetic peptide
  Seed: DILDTAGKEEY (NRAS Q61K)
DGLDTAGKEEY

SEQ ID NO: 13052 - protein, 11 aa, Artificial Sequence
  Description of Artificial Sequence: Synthetic peptide
  Seed: DILDTAGKEEY (NRAS Q61K)
DHLDTAGKEEY

SEQ ID NO: 13053 - protein, 11 aa, Artificial Sequence
  Description of Artificial Sequence: Synthetic peptide
  Seed: DTAGKEEYSAM (NRAS Q61K)
DIAGKEEYSAK

SEQ ID NO: 13054 - protein, 11 aa, Artificial Sequence
  Description of Artificial Sequence: Synthetic peptide
  Seed: DTAGKEEYSAM (NRAS Q61K)
DIAGKEEYSAR

SEQ ID NO: 13055 - protein, 11 aa, Artificial Sequence
  Description of Artificial Sequence: Synthetic peptide
  Seed: DILDTAGKEEY (NRAS Q61K)
DILDTAGKEEF

SEQ ID NO: 13056 - protein, 11 aa, Artificial Sequence
  Description of Artificial Sequence: Synthetic peptide
  Seed: DILDTAGKEEY (NRAS Q61K)
DILDTAGKEEK

SEQ ID NO: 13057 - protein, 11 aa, Artificial Sequence
  Description of Artificial Sequence: Synthetic peptide
  Seed: DILDTAGKEEY (NRAS Q61K)
DILDTAGKEER

SEQ ID NO: 13058 - protein, 11 aa, Artificial Sequence
  Description of Artificial Sequence: Synthetic peptide
  Seed: DILDTAGKEEY (NRAS Q61K)
DILDTAGKEEW

SEQ ID NO: 13059 - protein, 11 aa, Artificial Sequence
  Description of Artificial Sequence: Synthetic peptide
  Seed: DILDTAGKEEY (NRAS Q61K)
DKLDTAGKEEY

SEQ ID NO: 13060 - protein, 11 aa, Artificial Sequence
  Description of Artificial Sequence: Synthetic peptide
  Seed: DTAGKEEYSAM (NRAS Q61K)
DLAGKEEYSAK

SEQ ID NO: 13061 - protein, 11 aa, Artificial Sequence
  Description of Artificial Sequence: Synthetic peptide
  Seed: DTAGKEEYSAM (NRAS Q61K)
DLAGKEEYSAR

SEQ ID NO: 13062 - protein, 11 aa, Artificial Sequence
  Description of Artificial Sequence: Synthetic peptide
  Seed: DILDTAGKEEY (NRAS Q61K)
DLLDTAGKEEF

SEQ ID NO: 13063 - protein, 11 aa, Artificial Sequence
  Description of Artificial Sequence: Synthetic peptide
  Seed: DILDTAGKEEY (NRAS Q61K)
DLLDTAGKEEK

SEQ ID NO: 13064 - protein, 11 aa, Artificial Sequence
  Description of Artificial Sequence: Synthetic peptide
  Seed: DILDTAGKEEY (NRAS Q61K)
DLLDTAGKEER

SEQ ID NO: 13065 - protein, 11 aa, Artificial Sequence
  Description of Artificial Sequence: Synthetic peptide
  Seed: DILDTAGKEEY (NRAS Q61K)
DLLDTAGKEEW

SEQ ID NO: 13066 - protein, 11 aa, Artificial Sequence
  Description of Artificial Sequence: Synthetic peptide
  Seed: DILDTAGKEEY (NRAS Q61K)
DLLDTAGKEEY

SEQ ID NO: 13067 - protein, 11 aa, Artificial Sequence
  Description of Artificial Sequence: Synthetic peptide
  Seed: DTAGKEEYSAM (NRAS Q61K)
DMAGKEEYSAK

SEQ ID NO: 13068 - protein, 11 aa, Artificial Sequence
  Description of Artificial Sequence: Synthetic peptide
  Seed: DTAGKEEYSAM (NRAS Q61K)
DMAGKEEYSAR

SEQ ID NO: 13069 - protein, 11 aa, Artificial Sequence
  Description of Artificial Sequence: Synthetic peptide
  Seed: DILDTAGKEEY (NRAS Q61K)
DMLDTAGKEEF

SEQ ID NO: 13070 - protein, 11 aa, Artificial Sequence
  Description of Artificial Sequence: Synthetic peptide
  Seed: DILDTAGKEEY (NRAS Q61K)
DMLDTAGKEEK

SEQ ID NO: 13071 - protein, 11 aa, Artificial Sequence
  Description of Artificial Sequence: Synthetic peptide
  Seed: DILDTAGKEEY (NRAS Q61K)
DMLDTAGKEEM

SEQ ID NO: 13072 - protein, 11 aa, Artificial Sequence
  Description of Artificial Sequence: Synthetic peptide
  Seed: DILDTAGKEEY (NRAS Q61K)
DMLDTAGKEER

SEQ ID NO: 13073 - protein, 11 aa, Artificial Sequence
  Description of Artificial Sequence: Synthetic peptide
  Seed: DILDTAGKEEY (NRAS Q61K)
DMLDTAGKEEW

SEQ ID NO: 13074 - protein, 11 aa, Artificial Sequence
  Description of Artificial Sequence: Synthetic peptide
  Seed: DILDTAGKEEY (NRAS Q61K)
DMLDTAGKEEY

SEQ ID NO: 13075 - protein, 11 aa, Artificial Sequence
  Description of Artificial Sequence: Synthetic peptide
  Seed: DTAGKEEYSAM (NRAS Q61K)
DNAGKEEYSAK

SEQ ID NO: 13076 - protein, 11 aa, Artificial Sequence
  Description of Artificial Sequence: Synthetic peptide
  Seed: DTAGKEEYSAM (NRAS Q61K)
DNAGKEEYSAR

SEQ ID NO: 13077 - protein, 11 aa, Artificial Sequence
  Description of Artificial Sequence: Synthetic peptide
  Seed: DILDTAGKEEY (NRAS Q61K)
DNLDTAGKEEK

SEQ ID NO: 13078 - protein, 11 aa, Artificial Sequence
  Description of Artificial Sequence: Synthetic peptide
  Seed: DILDTAGKEEY (NRAS Q61K)
DNLDTAGKEER

SEQ ID NO: 13079 - protein, 11 aa, Artificial Sequence
  Description of Artificial Sequence: Synthetic peptide
  Seed: DILDTAGKEEY (NRAS Q61K)
DNLDTAGKEEY

SEQ ID NO: 13080 - protein, 11 aa, Artificial Sequence
  Description of Artificial Sequence: Synthetic peptide
  Seed: DILDTAGKEEY (NRAS Q61K)
DPLDTAGKEEF

SEQ ID NO: 13081 - protein, 11 aa, Artificial Sequence
  Description of Artificial Sequence: Synthetic peptide
  Seed: DILDTAGKEEY (NRAS Q61K)
DPLDTAGKEEL

SEQ ID NO: 13082 - protein, 11 aa, Artificial Sequence
  Description of Artificial Sequence: Synthetic peptide
  Seed: DILDTAGKEEY (NRAS Q61K)
DPLDTAGKEEM

SEQ ID NO: 13083 - protein, 11 aa, Artificial Sequence
  Description of Artificial Sequence: Synthetic peptide
  Seed: DILDTAGKEEY (NRAS Q61K)
DPLDTAGKEEW

SEQ ID NO: 13084 - protein, 11 aa, Artificial Sequence
  Description of Artificial Sequence: Synthetic peptide
  Seed: DILDTAGKEEY (NRAS Q61K)
DPLDTAGKEEY

SEQ ID NO: 13085 - protein, 11 aa, Artificial Sequence
  Description of Artificial Sequence: Synthetic peptide
  Seed: DTAGKEEYSAM (NRAS Q61K)
DQAGKEEYSAK

SEQ ID NO: 13086 - protein, 11 aa, Artificial Sequence
  Description of Artificial Sequence: Synthetic peptide
  Seed: DTAGKEEYSAM (NRAS Q61K)
DQAGKEEYSAR

SEQ ID NO: 13087 - protein, 11 aa, Artificial Sequence
  Description of Artificial Sequence: Synthetic peptide
  Seed: DILDTAGKEEY (NRAS Q61K)
DQLDTAGKEEF

SEQ ID NO: 13088 - protein, 11 aa, Artificial Sequence
  Description of Artificial Sequence: Synthetic peptide
  Seed: DILDTAGKEEY (NRAS Q61K)
DQLDTAGKEEK

SEQ ID NO: 13089 - protein, 11 aa, Artificial Sequence
  Description of Artificial Sequence: Synthetic peptide
  Seed: DILDTAGKEEY (NRAS Q61K)
DQLDTAGKEEL

SEQ ID NO: 13090 - protein, 11 aa, Artificial Sequence
  Description of Artificial Sequence: Synthetic peptide
  Seed: DILDTAGKEEY (NRAS Q61K)
DQLDTAGKEEM

SEQ ID NO: 13091 - protein, 11 aa, Artificial Sequence
  Description of Artificial Sequence: Synthetic peptide
  Seed: DILDTAGKEEY (NRAS Q61K)
DQLDTAGKEER

SEQ ID NO: 13092 - protein, 11 aa, Artificial Sequence
  Description of Artificial Sequence: Synthetic peptide
  Seed: DILDTAGKEEY (NRAS Q61K)
DQLDTAGKEEW

SEQ ID NO: 13093 - protein, 11 aa, Artificial Sequence
  Description of Artificial Sequence: Synthetic peptide
  Seed: DILDTAGKEEY (NRAS Q61K)
DQLDTAGKEEY

SEQ ID NO: 13094 - protein, 11 aa, Artificial Sequence
  Description of Artificial Sequence: Synthetic peptide
  Seed: DTAGKEEYSAM (NRAS Q61K)
DSAGKEEYSAK

SEQ ID NO: 13095 - protein, 11 aa, Artificial Sequence
  Description of Artificial Sequence: Synthetic peptide
  Seed: DTAGKEEYSAM (NRAS Q61K)
DSAGKEEYSAR

SEQ ID NO: 13096 - protein, 11 aa, Artificial Sequence
  Description of Artificial Sequence: Synthetic peptide
  Seed: DILDTAGKEEY (NRAS Q61K)
DSLDTAGKEEF

SEQ ID NO: 13097 - protein, 11 aa, Artificial Sequence
  Description of Artificial Sequence: Synthetic peptide
  Seed: DILDTAGKEEY (NRAS Q61K)
DSLDTAGKEEK

SEQ ID NO: 13098 - protein, 11 aa, Artificial Sequence
  Description of Artificial Sequence: Synthetic peptide
  Seed: DILDTAGKEEY (NRAS Q61K)
DSLDTAGKEER

SEQ ID NO: 13099 - protein, 11 aa, Artificial Sequence
  Description of Artificial Sequence: Synthetic peptide
  Seed: DILDTAGKEEY (NRAS Q61K)
DSLDTAGKEEW

SEQ ID NO: 13100 - protein, 11 aa, Artificial Sequence
  Description of Artificial Sequence: Synthetic peptide
  Seed: DILDTAGKEEY (NRAS Q61K)
DSLDTAGKEEY

SEQ ID NO: 13101 - protein, 11 aa, Artificial Sequence
  Description of Artificial Sequence: Synthetic peptide
  Seed: DTAGKEEYSAM (NRAS Q61K)
DTAGKEEYSAH

SEQ ID NO: 13102 - protein, 11 aa, Artificial Sequence
  Description of Artificial Sequence: Synthetic peptide
  Seed: DTAGKEEYSAM (NRAS Q61K)
DTAGKEEYSAK

SEQ ID NO: 13103 - protein, 11 aa, Artificial Sequence
  Description of Artificial Sequence: Synthetic peptide
  Seed: DTAGKEEYSAM (NRAS Q61K)
DTAGKEEYSAR

SEQ ID NO: 13104 - protein, 11 aa, Artificial Sequence
  Description of Artificial Sequence: Synthetic peptide
  Seed: DTAGKEEYSAM (NRAS Q61K)
DTAGKEEYSAY

SEQ ID NO: 13105 - protein, 11 aa, Artificial Sequence
  Description of Artificial Sequence: Synthetic peptide
  Seed: DILDTAGKEEY (NRAS Q61K)
DTLDTAGKEEF

SEQ ID NO: 13106 - protein, 11 aa, Artificial Sequence
  Description of Artificial Sequence: Synthetic peptide
  Seed: DILDTAGKEEY (NRAS Q61K)
DTLDTAGKEEH

SEQ ID NO: 13107 - protein, 11 aa, Artificial Sequence
  Description of Artificial Sequence: Synthetic peptide
  Seed: DILDTAGKEEY (NRAS Q61K)
DTLDTAGKEEK

SEQ ID NO: 13108 - protein, 11 aa, Artificial Sequence
  Description of Artificial Sequence: Synthetic peptide
  Seed: DILDTAGKEEY (NRAS Q61K)
DTLDTAGKEEL

SEQ ID NO: 13109 - protein, 11 aa, Artificial Sequence
  Description of Artificial Sequence: Synthetic peptide
  Seed: DILDTAGKEEY (NRAS Q61K)
DTLDTAGKEEM

SEQ ID NO: 13110 - protein, 11 aa, Artificial Sequence
  Description of Artificial Sequence: Synthetic peptide
  Seed: DILDTAGKEEY (NRAS Q61K)
DTLDTAGKEER

SEQ ID NO: 13111 - protein, 11 aa, Artificial Sequence
  Description of Artificial Sequence: Synthetic peptide
  Seed: DILDTAGKEEY (NRAS Q61K)
DTLDTAGKEEW

SEQ ID NO: 13112 - protein, 11 aa, Artificial Sequence
  Description of Artificial Sequence: Synthetic peptide
  Seed: DILDTAGKEEY (NRAS Q61K)
DTLDTAGKEEY

SEQ ID NO: 13113 - protein, 11 aa, Artificial Sequence
  Description of Artificial Sequence: Synthetic peptide
  Seed: DTAGKEEYSAM (NRAS Q61K)
DVAGKEEYSAH

SEQ ID NO: 13114 - protein, 11 aa, Artificial Sequence
  Description of Artificial Sequence: Synthetic peptide
  Seed: DTAGKEEYSAM (NRAS Q61K)
DVAGKEEYSAK

SEQ ID NO: 13115 - protein, 11 aa, Artificial Sequence
  Description of Artificial Sequence: Synthetic peptide
  Seed: DTAGKEEYSAM (NRAS Q61K)
DVAGKEEYSAM

SEQ ID NO: 13116 - protein, 11 aa, Artificial Sequence
  Description of Artificial Sequence: Synthetic peptide
  Seed: DTAGKEEYSAM (NRAS Q61K)
DVAGKEEYSAR

SEQ ID NO: 13117 - protein, 11 aa, Artificial Sequence
  Description of Artificial Sequence: Synthetic peptide
  Seed: DTAGKEEYSAM (NRAS Q61K)
DVAGKEEYSAY

SEQ ID NO: 13118 - protein, 11 aa, Artificial Sequence
  Description of Artificial Sequence: Synthetic peptide
  Seed: DILDTAGKEEY (NRAS Q61K)
DVLDTAGKEEF

SEQ ID NO: 13119 - protein, 11 aa, Artificial Sequence
  Description of Artificial Sequence: Synthetic peptide
  Seed: DILDTAGKEEY (NRAS Q61K)
DVLDTAGKEEH

SEQ ID NO: 13120 - protein, 11 aa, Artificial Sequence
  Description of Artificial Sequence: Synthetic peptide
  Seed: DILDTAGKEEY (NRAS Q61K)
DVLDTAGKEEK

SEQ ID NO: 13121 - protein, 11 aa, Artificial Sequence
  Description of Artificial Sequence: Synthetic peptide
  Seed: DILDTAGKEEY (NRAS Q61K)
DVLDTAGKEEL

SEQ ID NO: 13122 - protein, 11 aa, Artificial Sequence
  Description of Artificial Sequence: Synthetic peptide
  Seed: DILDTAGKEEY (NRAS Q61K)
DVLDTAGKEEM

SEQ ID NO: 13123 - protein, 11 aa, Artificial Sequence
  Description of Artificial Sequence: Synthetic peptide
  Seed: DILDTAGKEEY (NRAS Q61K)
DVLDTAGKEEQ

SEQ ID NO: 13124 - protein, 11 aa, Artificial Sequence
  Description of Artificial Sequence: Synthetic peptide
  Seed: DILDTAGKEEY (NRAS Q61K)
DVLDTAGKEER

SEQ ID NO: 13125 - protein, 11 aa, Artificial Sequence
  Description of Artificial Sequence: Synthetic peptide
  Seed: DILDTAGKEEY (NRAS Q61K)
DVLDTAGKEEW

SEQ ID NO: 13126 - protein, 11 aa, Artificial Sequence
  Description of Artificial Sequence: Synthetic peptide
  Seed: DILDTAGKEEY (NRAS Q61K)
DVLDTAGKEEY

SEQ ID NO: 13127 - protein, 11 aa, Artificial Sequence
  Description of Artificial Sequence: Synthetic peptide
  Seed: DILDTAGKEEY (NRAS Q61K)
DWLDTAGKEEY

SEQ ID NO: 13128 - protein, 11 aa, Artificial Sequence
  Description of Artificial Sequence: Synthetic peptide
  Seed: DILDTAGKEEY (NRAS Q61K)
DYLDTAGKEER

SEQ ID NO: 13129 - protein, 11 aa, Artificial Sequence
  Description of Artificial Sequence: Synthetic peptide
  Seed: DILDTAGKEEY (NRAS Q61K)
DYLDTAGKEEY

SEQ ID NO: 13130 - protein, 10 aa, Artificial Sequence
  Description of Artificial Sequence: Synthetic peptide
  Seed: ILDTAGKEEY (NRAS Q61K)
IADTAGKEEA

SEQ ID NO: 13131 - protein, 10 aa, Artificial Sequence
  Description of Artificial Sequence: Synthetic peptide
  Seed: ILDTAGKEEY (NRAS Q61K)
IADTAGKEEC

SEQ ID NO: 13132 - protein, 10 aa, Artificial Sequence
  Description of Artificial Sequence: Synthetic peptide
  Seed: ILDTAGKEEY (NRAS Q61K)
IADTAGKEEF

SEQ ID NO: 13133 - protein, 10 aa, Artificial Sequence
  Description of Artificial Sequence: Synthetic peptide
  Seed: ILDTAGKEEY (NRAS Q61K)
IADTAGKEEH

SEQ ID NO: 13134 - protein, 10 aa, Artificial Sequence
  Description of Artificial Sequence: Synthetic peptide
  Seed: ILDTAGKEEY (NRAS Q61K)
IADTAGKEEI

SEQ ID NO: 13135 - protein, 10 aa, Artificial Sequence
  Description of Artificial Sequence: Synthetic peptide
  Seed: ILDTAGKEEY (NRAS Q61K)
IADTAGKEEK

SEQ ID NO: 13136 - protein, 10 aa, Artificial Sequence
  Description of Artificial Sequence: Synthetic peptide
  Seed: ILDTAGKEEY (NRAS Q61K)
IADTAGKEEL

SEQ ID NO: 13137 - protein, 10 aa, Artificial Sequence
  Description of Artificial Sequence: Synthetic peptide
  Seed: ILDTAGKEEY (NRAS Q61K)
IADTAGKEEM

SEQ ID NO: 13138 - protein, 10 aa, Artificial Sequence
  Description of Artificial Sequence: Synthetic peptide
  Seed: ILDTAGKEEY (NRAS Q61K)
IADTAGKEER

SEQ ID NO: 13139 - protein, 10 aa, Artificial Sequence
  Description of Artificial Sequence: Synthetic peptide
  Seed: ILDTAGKEEY (NRAS Q61K)
IADTAGKEET

SEQ ID NO: 13140 - protein, 10 aa, Artificial Sequence
  Description of Artificial Sequence: Synthetic peptide
  Seed: ILDTAGKEEY (NRAS Q61K)
IADTAGKEEV

SEQ ID NO: 13141 - protein, 10 aa, Artificial Sequence
  Description of Artificial Sequence: Synthetic peptide
  Seed: ILDTAGKEEY (NRAS Q61K)
IADTAGKEEW

SEQ ID NO: 13142 - protein, 10 aa, Artificial Sequence
  Description of Artificial Sequence: Synthetic peptide
  Seed: ILDTAGKEEY (NRAS Q61K)
ICDTAGKEEF

SEQ ID NO: 13143 - protein, 10 aa, Artificial Sequence
  Description of Artificial Sequence: Synthetic peptide
  Seed: ILDTAGKEEY (NRAS Q61K)
ICDTAGKEEI

SEQ ID NO: 13144 - protein, 10 aa, Artificial Sequence
  Description of Artificial Sequence: Synthetic peptide
  Seed: ILDTAGKEEY (NRAS Q61K)
ICDTAGKEEK

SEQ ID NO: 13145 - protein, 10 aa, Artificial Sequence
  Description of Artificial Sequence: Synthetic peptide
  Seed: ILDTAGKEEY (NRAS Q61K)
ICDTAGKEEL

SEQ ID NO: 13146 - protein, 10 aa, Artificial Sequence
  Description of Artificial Sequence: Synthetic peptide
  Seed: ILDTAGKEEY (NRAS Q61K)
ICDTAGKEEM

SEQ ID NO: 13147 - protein, 10 aa, Artificial Sequence
  Description of Artificial Sequence: Synthetic peptide
  Seed: ILDTAGKEEY (NRAS Q61K)
ICDTAGKEEV

SEQ ID NO: 13148 - protein, 10 aa, Artificial Sequence
  Description of Artificial Sequence: Synthetic peptide
  Seed: ILDTAGKEEY (NRAS Q61K)
ICDTAGKEEW

SEQ ID NO: 13149 - protein, 10 aa, Artificial Sequence
  Description of Artificial Sequence: Synthetic peptide
  Seed: ILDTAGKEEY (NRAS Q61K)
ICDTAGKEEY

SEQ ID NO: 13150 - protein, 10 aa, Artificial Sequence
  Description of Artificial Sequence: Synthetic peptide
  Seed: ILDTAGKEEY (NRAS Q61K)
IDDTAGKEEF

SEQ ID NO: 13151 - protein, 10 aa, Artificial Sequence
  Description of Artificial Sequence: Synthetic peptide
  Seed: ILDTAGKEEY (NRAS Q61K)
IDDTAGKEEI

SEQ ID NO: 13152 - protein, 10 aa, Artificial Sequence
  Description of Artificial Sequence: Synthetic peptide
  Seed: ILDTAGKEEY (NRAS Q61K)
IDDTAGKEEK

SEQ ID NO: 13153 - protein, 10 aa, Artificial Sequence
  Description of Artificial Sequence: Synthetic peptide
  Seed: ILDTAGKEEY (NRAS Q61K)
IDDTAGKEEL

SEQ ID NO: 13154 - protein, 10 aa, Artificial Sequence
  Description of Artificial Sequence: Synthetic peptide
  Seed: ILDTAGKEEY (NRAS Q61K)
IDDTAGKEEM

SEQ ID NO: 13155 - protein, 10 aa, Artificial Sequence
  Description of Artificial Sequence: Synthetic peptide
  Seed: ILDTAGKEEY (NRAS Q61K)
IDDTAGKEER

SEQ ID NO: 13156 - protein, 10 aa, Artificial Sequence
  Description of Artificial Sequence: Synthetic peptide
  Seed: ILDTAGKEEY (NRAS Q61K)
IDDTAGKEEW

SEQ ID NO: 13157 - protein, 10 aa, Artificial Sequence
  Description of Artificial Sequence: Synthetic peptide
  Seed: ILDTAGKEEY (NRAS Q61K)
IDDTAGKEEY

SEQ ID NO: 13158 - protein, 10 aa, Artificial Sequence
  Description of Artificial Sequence: Synthetic peptide
  Seed: ILDTAGKEEY (NRAS Q61K)
IEDTAGKEEF

SEQ ID NO: 13159 - protein, 10 aa, Artificial Sequence
  Description of Artificial Sequence: Synthetic peptide
  Seed: ILDTAGKEEY (NRAS Q61K)
IEDTAGKEEI

SEQ ID NO: 13160 - protein, 10 aa, Artificial Sequence
  Description of Artificial Sequence: Synthetic peptide
  Seed: ILDTAGKEEY (NRAS Q61K)
IEDTAGKEEK

SEQ ID NO: 13161 - protein, 10 aa, Artificial Sequence
  Description of Artificial Sequence: Synthetic peptide
  Seed: ILDTAGKEEY (NRAS Q61K)
IEDTAGKEEL

SEQ ID NO: 13162 - protein, 10 aa, Artificial Sequence
  Description of Artificial Sequence: Synthetic peptide
  Seed: ILDTAGKEEY (NRAS Q61K)
IEDTAGKEEM

SEQ ID NO: 13163 - protein, 10 aa, Artificial Sequence
  Description of Artificial Sequence: Synthetic peptide
  Seed: ILDTAGKEEY (NRAS Q61K)
IEDTAGKEER

SEQ ID NO: 13164 - protein, 10 aa, Artificial Sequence
  Description of Artificial Sequence: Synthetic peptide
  Seed: ILDTAGKEEY (NRAS Q61K)
IEDTAGKEEV

SEQ ID NO: 13165 - protein, 10 aa, Artificial Sequence
  Description of Artificial Sequence: Synthetic peptide
  Seed: ILDTAGKEEY (NRAS Q61K)
IEDTAGKEEW

SEQ ID NO: 13166 - protein, 10 aa, Artificial Sequence
  Description of Artificial Sequence: Synthetic peptide
  Seed: ILDTAGKEEY (NRAS Q61K)
IEDTAGKEEY

SEQ ID NO: 13167 - protein, 10 aa, Artificial Sequence
  Description of Artificial Sequence: Synthetic peptide
  Seed: ILDTAGKEEY (NRAS Q61K)
IFDTAGKEEA

SEQ ID NO: 13168 - protein, 10 aa, Artificial Sequence
  Description of Artificial Sequence: Synthetic peptide
  Seed: ILDTAGKEEY (NRAS Q61K)
IFDTAGKEEC

SEQ ID NO: 13169 - protein, 10 aa, Artificial Sequence
  Description of Artificial Sequence: Synthetic peptide
  Seed: ILDTAGKEEY (NRAS Q61K)
IFDTAGKEEF

SEQ ID NO: 13170 - protein, 10 aa, Artificial Sequence
  Description of Artificial Sequence: Synthetic peptide
  Seed: ILDTAGKEEY (NRAS Q61K)
IFDTAGKEEI

SEQ ID NO: 13171 - protein, 10 aa, Artificial Sequence
  Description of Artificial Sequence: Synthetic peptide
  Seed: ILDTAGKEEY (NRAS Q61K)
IFDTAGKEEK

SEQ ID NO: 13172 - protein, 10 aa, Artificial Sequence
  Description of Artificial Sequence: Synthetic peptide
  Seed: ILDTAGKEEY (NRAS Q61K)
IFDTAGKEEL

SEQ ID NO: 13173 - protein, 10 aa, Artificial Sequence
  Description of Artificial Sequence: Synthetic peptide
  Seed: ILDTAGKEEY (NRAS Q61K)
IFDTAGKEEM

SEQ ID NO: 13174 - protein, 10 aa, Artificial Sequence
  Description of Artificial Sequence: Synthetic peptide
  Seed: ILDTAGKEEY (NRAS Q61K)
IFDTAGKEER

SEQ ID NO: 13175 - protein, 10 aa, Artificial Sequence
  Description of Artificial Sequence: Synthetic peptide
  Seed: ILDTAGKEEY (NRAS Q61K)
IFDTAGKEET

SEQ ID NO: 13176 - protein, 10 aa, Artificial Sequence
  Description of Artificial Sequence: Synthetic peptide
  Seed: ILDTAGKEEY (NRAS Q61K)
IFDTAGKEEV

SEQ ID NO: 13177 - protein, 10 aa, Artificial Sequence
  Description of Artificial Sequence: Synthetic peptide
  Seed: ILDTAGKEEY (NRAS Q61K)
IFDTAGKEEW

SEQ ID NO: 13178 - protein, 10 aa, Artificial Sequence
  Description of Artificial Sequence: Synthetic peptide
  Seed: ILDTAGKEEY (NRAS Q61K)
IGDTAGKEEF

SEQ ID NO: 13179 - protein, 10 aa, Artificial Sequence
  Description of Artificial Sequence: Synthetic peptide
  Seed: ILDTAGKEEY (NRAS Q61K)
IGDTAGKEEI

SEQ ID NO: 13180 - protein, 10 aa, Artificial Sequence
  Description of Artificial Sequence: Synthetic peptide
  Seed: ILDTAGKEEY (NRAS Q61K)
IGDTAGKEEK

SEQ ID NO: 13181 - protein, 10 aa, Artificial Sequence
  Description of Artificial Sequence: Synthetic peptide
  Seed: ILDTAGKEEY (NRAS Q61K)
IGDTAGKEEL

SEQ ID NO: 13182 - protein, 10 aa, Artificial Sequence
  Description of Artificial Sequence: Synthetic peptide
  Seed: ILDTAGKEEY (NRAS Q61K)
IGDTAGKEEM

SEQ ID NO: 13183 - protein, 10 aa, Artificial Sequence
  Description of Artificial Sequence: Synthetic peptide
  Seed: ILDTAGKEEY (NRAS Q61K)
IGDTAGKEER

SEQ ID NO: 13184 - protein, 10 aa, Artificial Sequence
  Description of Artificial Sequence: Synthetic peptide
  Seed: ILDTAGKEEY (NRAS Q61K)
IGDTAGKEEV

SEQ ID NO: 13185 - protein, 10 aa, Artificial Sequence
  Description of Artificial Sequence: Synthetic peptide
  Seed: ILDTAGKEEY (NRAS Q61K)
IGDTAGKEEW

SEQ ID NO: 13186 - protein, 10 aa, Artificial Sequence
  Description of Artificial Sequence: Synthetic peptide
  Seed: ILDTAGKEEY (NRAS Q61K)
IGDTAGKEEY

SEQ ID NO: 13187 - protein, 10 aa, Artificial Sequence
  Description of Artificial Sequence: Synthetic peptide
  Seed: ILDTAGKEEY (NRAS Q61K)
IHDTAGKEEF

SEQ ID NO: 13188 - protein, 10 aa, Artificial Sequence
  Description of Artificial Sequence: Synthetic peptide
  Seed: ILDTAGKEEY (NRAS Q61K)
IHDTAGKEEI

SEQ ID NO: 13189 - protein, 10 aa, Artificial Sequence
  Description of Artificial Sequence: Synthetic peptide
  Seed: ILDTAGKEEY (NRAS Q61K)
IHDTAGKEEK

SEQ ID NO: 13190 - protein, 10 aa, Artificial Sequence
  Description of Artificial Sequence: Synthetic peptide
  Seed: ILDTAGKEEY (NRAS Q61K)
IHDTAGKEEL

SEQ ID NO: 13191 - protein, 10 aa, Artificial Sequence
  Description of Artificial Sequence: Synthetic peptide
  Seed: ILDTAGKEEY (NRAS Q61K)
IHDTAGKEEM

SEQ ID NO: 13192 - protein, 10 aa, Artificial Sequence
  Description of Artificial Sequence: Synthetic peptide
  Seed: ILDTAGKEEY (NRAS Q61K)
IHDTAGKEEV

SEQ ID NO: 13193 - protein, 10 aa, Artificial Sequence
  Description of Artificial Sequence: Synthetic peptide
  Seed: ILDTAGKEEY (NRAS Q61K)
IHDTAGKEEW

SEQ ID NO: 13194 - protein, 10 aa, Artificial Sequence
  Description of Artificial Sequence: Synthetic peptide
  Seed: ILDTAGKEEY (NRAS Q61K)
IHDTAGKEEY

SEQ ID NO: 13195 - protein, 10 aa, Artificial Sequence
  Description of Artificial Sequence: Synthetic peptide
  Seed: ILDTAGKEEY (NRAS Q61K)
IIDTAGKEEA

SEQ ID NO: 13196 - protein, 10 aa, Artificial Sequence
  Description of Artificial Sequence: Synthetic peptide
  Seed: ILDTAGKEEY (NRAS Q61K)
IIDTAGKEEC

SEQ ID NO: 13197 - protein, 10 aa, Artificial Sequence
  Description of Artificial Sequence: Synthetic peptide
  Seed: ILDTAGKEEY (NRAS Q61K)
IIDTAGKEEF

SEQ ID NO: 13198 - protein, 10 aa, Artificial Sequence
  Description of Artificial Sequence: Synthetic peptide
  Seed: ILDTAGKEEY (NRAS Q61K)
IIDTAGKEEH

SEQ ID NO: 13199 - protein, 10 aa, Artificial Sequence
  Description of Artificial Sequence: Synthetic peptide
  Seed: ILDTAGKEEY (NRAS Q61K)
IIDTAGKEEI

SEQ ID NO: 13200 - protein, 10 aa, Artificial Sequence
  Description of Artificial Sequence: Synthetic peptide
  Seed: ILDTAGKEEY (NRAS Q61K)
IIDTAGKEEK

SEQ ID NO: 13201 - protein, 10 aa, Artificial Sequence
  Description of Artificial Sequence: Synthetic peptide
  Seed: ILDTAGKEEY (NRAS Q61K)
IIDTAGKEEL

SEQ ID NO: 13202 - protein, 10 aa, Artificial Sequence
  Description of Artificial Sequence: Synthetic peptide
  Seed: ILDTAGKEEY (NRAS Q61K)
IIDTAGKEEM

SEQ ID NO: 13203 - protein, 10 aa, Artificial Sequence
  Description of Artificial Sequence: Synthetic peptide
  Seed: ILDTAGKEEY (NRAS Q61K)
IIDTAGKEER

SEQ ID NO: 13204 - protein, 10 aa, Artificial Sequence
  Description of Artificial Sequence: Synthetic peptide
  Seed: ILDTAGKEEY (NRAS Q61K)
IIDTAGKEET

SEQ ID NO: 13205 - protein, 10 aa, Artificial Sequence
  Description of Artificial Sequence: Synthetic peptide
  Seed: ILDTAGKEEY (NRAS Q61K)
IIDTAGKEEV

SEQ ID NO: 13206 - protein, 10 aa, Artificial Sequence
  Description of Artificial Sequence: Synthetic peptide
  Seed: ILDTAGKEEY (NRAS Q61K)
IIDTAGKEEW

SEQ ID NO: 13207 - protein, 10 aa, Artificial Sequence
  Description of Artificial Sequence: Synthetic peptide
  Seed: ILDTAGKEEY (NRAS Q61K)
IKDTAGKEEF

SEQ ID NO: 13208 - protein, 10 aa, Artificial Sequence
  Description of Artificial Sequence: Synthetic peptide
  Seed: ILDTAGKEEY (NRAS Q61K)
IKDTAGKEEL

SEQ ID NO: 13209 - protein, 10 aa, Artificial Sequence
  Description of Artificial Sequence: Synthetic peptide
  Seed: ILDTAGKEEY (NRAS Q61K)
IKDTAGKEEM

SEQ ID NO: 13210 - protein, 10 aa, Artificial Sequence
  Description of Artificial Sequence: Synthetic peptide
  Seed: ILDTAGKEEY (NRAS Q61K)
IKDTAGKEEW

SEQ ID NO: 13211 - protein, 10 aa, Artificial Sequence
  Description of Artificial Sequence: Synthetic peptide
  Seed: ILDTAGKEEY (NRAS Q61K)
IKDTAGKEEY

SEQ ID NO: 13212 - protein, 10 aa, Artificial Sequence
  Description of Artificial Sequence: Synthetic peptide
  Seed: ILDTAGKEEY (NRAS Q61K)
ILDTAGKEEA

SEQ ID NO: 13213 - protein, 10 aa, Artificial Sequence
  Description of Artificial Sequence: Synthetic peptide
  Seed: ILDTAGKEEY (NRAS Q61K)
ILDTAGKEEC

SEQ ID NO: 13214 - protein, 10 aa, Artificial Sequence
  Description of Artificial Sequence: Synthetic peptide
  Seed: ILDTAGKEEY (NRAS Q61K)
ILDTAGKEEF

SEQ ID NO: 13215 - protein, 10 aa, Artificial Sequence
  Description of Artificial Sequence: Synthetic peptide
  Seed: ILDTAGKEEY (NRAS Q61K)
ILDTAGKEEH

SEQ ID NO: 13216 - protein, 10 aa, Artificial Sequence
  Description of Artificial Sequence: Synthetic peptide
  Seed: ILDTAGKEEY (NRAS Q61K)
ILDTAGKEEI

SEQ ID NO: 13217 - protein, 10 aa, Artificial Sequence
  Description of Artificial Sequence: Synthetic peptide
  Seed: ILDTAGKEEY (NRAS Q61K)
ILDTAGKEEK

SEQ ID NO: 13218 - protein, 10 aa, Artificial Sequence
  Description of Artificial Sequence: Synthetic peptide
  Seed: ILDTAGKEEY (NRAS Q61K)
ILDTAGKEEM

SEQ ID NO: 13219 - protein, 10 aa, Artificial Sequence
  Description of Artificial Sequence: Synthetic peptide
  Seed: ILDTAGKEEY (NRAS Q61K)
ILDTAGKEER

SEQ ID NO: 13220 - protein, 10 aa, Artificial Sequence
  Description of Artificial Sequence: Synthetic peptide
  Seed: ILDTAGKEEY (NRAS Q61K)
ILDTAGKEEV

SEQ ID NO: 13221 - protein, 10 aa, Artificial Sequence
  Description of Artificial Sequence: Synthetic peptide
  Seed: ILDTAGKEEY (NRAS Q61K)
ILDTAGKEEW

SEQ ID NO: 13222 - protein, 10 aa, Artificial Sequence
  Description of Artificial Sequence: Synthetic peptide
  Seed: ILDTAGKEEY (NRAS Q61K)
IMDTAGKEEA

SEQ ID NO: 13223 - protein, 10 aa, Artificial Sequence
  Description of Artificial Sequence: Synthetic peptide
  Seed: ILDTAGKEEY (NRAS Q61K)
IMDTAGKEEC

SEQ ID NO: 13224 - protein, 10 aa, Artificial Sequence
  Description of Artificial Sequence: Synthetic peptide
  Seed: ILDTAGKEEY (NRAS Q61K)
IMDTAGKEEF

SEQ ID NO: 13225 - protein, 10 aa, Artificial Sequence
  Description of Artificial Sequence: Synthetic peptide
  Seed: ILDTAGKEEY (NRAS Q61K)
IMDTAGKEEH

SEQ ID NO: 13226 - protein, 10 aa, Artificial Sequence
  Description of Artificial Sequence: Synthetic peptide
  Seed: ILDTAGKEEY (NRAS Q61K)
IMDTAGKEEI

SEQ ID NO: 13227 - protein, 10 aa, Artificial Sequence
  Description of Artificial Sequence: Synthetic peptide
  Seed: ILDTAGKEEY (NRAS Q61K)
IMDTAGKEEK

SEQ ID NO: 13228 - protein, 10 aa, Artificial Sequence
  Description of Artificial Sequence: Synthetic peptide
  Seed: ILDTAGKEEY (NRAS Q61K)
IMDTAGKEEM

SEQ ID NO: 13229 - protein, 10 aa, Artificial Sequence
  Description of Artificial Sequence: Synthetic peptide
  Seed: ILDTAGKEEY (NRAS Q61K)
IMDTAGKEEQ

SEQ ID NO: 13230 - protein, 10 aa, Artificial Sequence
  Description of Artificial Sequence: Synthetic peptide
  Seed: ILDTAGKEEY (NRAS Q61K)
IMDTAGKEER

SEQ ID NO: 13231 - protein, 10 aa, Artificial Sequence
  Description of Artificial Sequence: Synthetic peptide
  Seed: ILDTAGKEEY (NRAS Q61K)
IMDTAGKEEV

SEQ ID NO: 13232 - protein, 10 aa, Artificial Sequence
  Description of Artificial Sequence: Synthetic peptide
  Seed: ILDTAGKEEY (NRAS Q61K)
IMDTAGKEEW

SEQ ID NO: 13233 - protein, 10 aa, Artificial Sequence
  Description of Artificial Sequence: Synthetic peptide
  Seed: ILDTAGKEEY (NRAS Q61K)
INDTAGKEEF

SEQ ID NO: 13234 - protein, 10 aa, Artificial Sequence
  Description of Artificial Sequence: Synthetic peptide
  Seed: ILDTAGKEEY (NRAS Q61K)
INDTAGKEEI

SEQ ID NO: 13235 - protein, 10 aa, Artificial Sequence
  Description of Artificial Sequence: Synthetic peptide
  Seed: ILDTAGKEEY (NRAS Q61K)
INDTAGKEEK

SEQ ID NO: 13236 - protein, 10 aa, Artificial Sequence
  Description of Artificial Sequence: Synthetic peptide
  Seed: ILDTAGKEEY (NRAS Q61K)
INDTAGKEEL

SEQ ID NO: 13237 - protein, 10 aa, Artificial Sequence
  Description of Artificial Sequence: Synthetic peptide
  Seed: ILDTAGKEEY (NRAS Q61K)
INDTAGKEEM

SEQ ID NO: 13238 - protein, 10 aa, Artificial Sequence
  Description of Artificial Sequence: Synthetic peptide
  Seed: ILDTAGKEEY (NRAS Q61K)
INDTAGKEER

SEQ ID NO: 13239 - protein, 10 aa, Artificial Sequence
  Description of Artificial Sequence: Synthetic peptide
  Seed: ILDTAGKEEY (NRAS Q61K)
INDTAGKEEV

SEQ ID NO: 13240 - protein, 10 aa, Artificial Sequence
  Description of Artificial Sequence: Synthetic peptide
  Seed: ILDTAGKEEY (NRAS Q61K)
INDTAGKEEW

SEQ ID NO: 13241 - protein, 10 aa, Artificial Sequence
  Description of Artificial Sequence: Synthetic peptide
  Seed: ILDTAGKEEY (NRAS Q61K)
INDTAGKEEY

SEQ ID NO: 13242 - protein, 10 aa, Artificial Sequence
  Description of Artificial Sequence: Synthetic peptide
  Seed: ILDTAGKEEY (NRAS Q61K)
IPDTAGKEEC

SEQ ID NO: 13243 - protein, 10 aa, Artificial Sequence
  Description of Artificial Sequence: Synthetic peptide
  Seed: ILDTAGKEEY (NRAS Q61K)
IPDTAGKEEF

SEQ ID NO: 13244 - protein, 10 aa, Artificial Sequence
  Description of Artificial Sequence: Synthetic peptide
  Seed: ILDTAGKEEY (NRAS Q61K)
IPDTAGKEEH

SEQ ID NO: 13245 - protein, 10 aa, Artificial Sequence
  Description of Artificial Sequence: Synthetic peptide
  Seed: ILDTAGKEEY (NRAS Q61K)
IPDTAGKEEI

SEQ ID NO: 13246 - protein, 10 aa, Artificial Sequence
  Description of Artificial Sequence: Synthetic peptide
  Seed: ILDTAGKEEY (NRAS Q61K)
IPDTAGKEEL

SEQ ID NO: 13247 - protein, 10 aa, Artificial Sequence
  Description of Artificial Sequence: Synthetic peptide
  Seed: ILDTAGKEEY (NRAS Q61K)
IPDTAGKEEM

SEQ ID NO: 13248 - protein, 10 aa, Artificial Sequence
  Description of Artificial Sequence: Synthetic peptide
  Seed: ILDTAGKEEY (NRAS Q61K)
IPDTAGKEEV

SEQ ID NO: 13249 - protein, 10 aa, Artificial Sequence
  Description of Artificial Sequence: Synthetic peptide
  Seed: ILDTAGKEEY (NRAS Q61K)
IPDTAGKEEW

SEQ ID NO: 13250 - protein, 10 aa, Artificial Sequence
  Description of Artificial Sequence: Synthetic peptide
  Seed: ILDTAGKEEY (NRAS Q61K)
IPDTAGKEEY

SEQ ID NO: 13251 - protein, 10 aa, Artificial Sequence
  Description of Artificial Sequence: Synthetic peptide
  Seed: ILDTAGKEEY (NRAS Q61K)
IQDTAGKEEF

SEQ ID NO: 13252 - protein, 10 aa, Artificial Sequence
  Description of Artificial Sequence: Synthetic peptide
  Seed: ILDTAGKEEY (NRAS Q61K)
IQDTAGKEEI

SEQ ID NO: 13253 - protein, 10 aa, Artificial Sequence
  Description of Artificial Sequence: Synthetic peptide
  Seed: ILDTAGKEEY (NRAS Q61K)
IQDTAGKEEK

SEQ ID NO: 13254 - protein, 10 aa, Artificial Sequence
  Description of Artificial Sequence: Synthetic peptide
  Seed: ILDTAGKEEY (NRAS Q61K)
IQDTAGKEEL

SEQ ID NO: 13255 - protein, 10 aa, Artificial Sequence
  Description of Artificial Sequence: Synthetic peptide
  Seed: ILDTAGKEEY (NRAS Q61K)
IQDTAGKEEM

SEQ ID NO: 13256 - protein, 10 aa, Artificial Sequence
  Description of Artificial Sequence: Synthetic peptide
  Seed: ILDTAGKEEY (NRAS Q61K)
IQDTAGKEER

SEQ ID NO: 13257 - protein, 10 aa, Artificial Sequence
  Description of Artificial Sequence: Synthetic peptide
  Seed: ILDTAGKEEY (NRAS Q61K)
IQDTAGKEEV

SEQ ID NO: 13258 - protein, 10 aa, Artificial Sequence
  Description of Artificial Sequence: Synthetic peptide
  Seed: ILDTAGKEEY (NRAS Q61K)
IQDTAGKEEW

SEQ ID NO: 13259 - protein, 10 aa, Artificial Sequence
  Description of Artificial Sequence: Synthetic peptide
  Seed: ILDTAGKEEY (NRAS Q61K)
IQDTAGKEEY

SEQ ID NO: 13260 - protein, 10 aa, Artificial Sequence
  Description of Artificial Sequence: Synthetic peptide
  Seed: ILDTAGKEEY (NRAS Q61K)
IRDTAGKEEF

SEQ ID NO: 13261 - protein, 10 aa, Artificial Sequence
  Description of Artificial Sequence: Synthetic peptide
  Seed: ILDTAGKEEY (NRAS Q61K)
IRDTAGKEEL

SEQ ID NO: 13262 - protein, 10 aa, Artificial Sequence
  Description of Artificial Sequence: Synthetic peptide
  Seed: ILDTAGKEEY (NRAS Q61K)
IRDTAGKEEM

SEQ ID NO: 13263 - protein, 10 aa, Artificial Sequence
  Description of Artificial Sequence: Synthetic peptide
  Seed: ILDTAGKEEY (NRAS Q61K)
IRDTAGKEEY

SEQ ID NO: 13264 - protein, 10 aa, Artificial Sequence
  Description of Artificial Sequence: Synthetic peptide
  Seed: ILDTAGKEEY (NRAS Q61K)
ISDTAGKEEA

SEQ ID NO: 13265 - protein, 10 aa, Artificial Sequence
  Description of Artificial Sequence: Synthetic peptide
  Seed: ILDTAGKEEY (NRAS Q61K)
ISDTAGKEEC

SEQ ID NO: 13266 - protein, 10 aa, Artificial Sequence
  Description of Artificial Sequence: Synthetic peptide
  Seed: ILDTAGKEEY (NRAS Q61K)
ISDTAGKEEF

SEQ ID NO: 13267 - protein, 10 aa, Artificial Sequence
  Description of Artificial Sequence: Synthetic peptide
  Seed: ILDTAGKEEY (NRAS Q61K)
ISDTAGKEEH

SEQ ID NO: 13268 - protein, 10 aa, Artificial Sequence
  Description of Artificial Sequence: Synthetic peptide
  Seed: ILDTAGKEEY (NRAS Q61K)
ISDTAGKEEI

SEQ ID NO: 13269 - protein, 10 aa, Artificial Sequence
  Description of Artificial Sequence: Synthetic peptide
  Seed: ILDTAGKEEY (NRAS Q61K)
ISDTAGKEEK

SEQ ID NO: 13270 - protein, 10 aa, Artificial Sequence
  Description of Artificial Sequence: Synthetic peptide
  Seed: ILDTAGKEEY (NRAS Q61K)
ISDTAGKEEL

SEQ ID NO: 13271 - protein, 10 aa, Artificial Sequence
  Description of Artificial Sequence: Synthetic peptide
  Seed: ILDTAGKEEY (NRAS Q61K)
ISDTAGKEEM

SEQ ID NO: 13272 - protein, 10 aa, Artificial Sequence
  Description of Artificial Sequence: Synthetic peptide
  Seed: ILDTAGKEEY (NRAS Q61K)
ISDTAGKEER

SEQ ID NO: 13273 - protein, 10 aa, Artificial Sequence
  Description of Artificial Sequence: Synthetic peptide
  Seed: ILDTAGKEEY (NRAS Q61K)
ISDTAGKEET

SEQ ID NO: 13274 - protein, 10 aa, Artificial Sequence
  Description of Artificial Sequence: Synthetic peptide
  Seed: ILDTAGKEEY (NRAS Q61K)
ISDTAGKEEV

SEQ ID NO: 13275 - protein, 10 aa, Artificial Sequence
  Description of Artificial Sequence: Synthetic peptide
  Seed: ILDTAGKEEY (NRAS Q61K)
ISDTAGKEEW

SEQ ID NO: 13276 - protein, 10 aa, Artificial Sequence
  Description of Artificial Sequence: Synthetic peptide
  Seed: ILDTAGKEEY (NRAS Q61K)
ITDTAGKEEA

SEQ ID NO: 13277 - protein, 10 aa, Artificial Sequence
  Description of Artificial Sequence: Synthetic peptide
  Seed: ILDTAGKEEY (NRAS Q61K)
ITDTAGKEEC

SEQ ID NO: 13278 - protein, 10 aa, Artificial Sequence
  Description of Artificial Sequence: Synthetic peptide
  Seed: ILDTAGKEEY (NRAS Q61K)
ITDTAGKEEF

SEQ ID NO: 13279 - protein, 10 aa, Artificial Sequence
  Description of Artificial Sequence: Synthetic peptide
  Seed: ILDTAGKEEY (NRAS Q61K)
ITDTAGKEEH

SEQ ID NO: 13280 - protein, 10 aa, Artificial Sequence
  Description of Artificial Sequence: Synthetic peptide
  Seed: ILDTAGKEEY (NRAS Q61K)
ITDTAGKEEI

SEQ ID NO: 13281 - protein, 10 aa, Artificial Sequence
  Description of Artificial Sequence: Synthetic peptide
  Seed: ILDTAGKEEY (NRAS Q61K)
ITDTAGKEEK

SEQ ID NO: 13282 - protein, 10 aa, Artificial Sequence
  Description of Artificial Sequence: Synthetic peptide
  Seed: ILDTAGKEEY (NRAS Q61K)
ITDTAGKEEL

SEQ ID NO: 13283 - protein, 10 aa, Artificial Sequence
  Description of Artificial Sequence: Synthetic peptide
  Seed: ILDTAGKEEY (NRAS Q61K)
ITDTAGKEEM

SEQ ID NO: 13284 - protein, 10 aa, Artificial Sequence
  Description of Artificial Sequence: Synthetic peptide
  Seed: ILDTAGKEEY (NRAS Q61K)
ITDTAGKEEQ

SEQ ID NO: 13285 - protein, 10 aa, Artificial Sequence
  Description of Artificial Sequence: Synthetic peptide
  Seed: ILDTAGKEEY (NRAS Q61K)
ITDTAGKEER

SEQ ID NO: 13286 - protein, 10 aa, Artificial Sequence
  Description of Artificial Sequence: Synthetic peptide
  Seed: ILDTAGKEEY (NRAS Q61K)
ITDTAGKEET

SEQ ID NO: 13287 - protein, 10 aa, Artificial Sequence
  Description of Artificial Sequence: Synthetic peptide
  Seed: ILDTAGKEEY (NRAS Q61K)
ITDTAGKEEV

SEQ ID NO: 13288 - protein, 10 aa, Artificial Sequence
  Description of Artificial Sequence: Synthetic peptide
  Seed: ILDTAGKEEY (NRAS Q61K)
ITDTAGKEEW

SEQ ID NO: 13289 - protein, 10 aa, Artificial Sequence
  Description of Artificial Sequence: Synthetic peptide
  Seed: ILDTAGKEEY (NRAS Q61K)
IVDTAGKEEA

SEQ ID NO: 13290 - protein, 10 aa, Artificial Sequence
  Description of Artificial Sequence: Synthetic peptide
  Seed: ILDTAGKEEY (NRAS Q61K)
IVDTAGKEEC

SEQ ID NO: 13291 - protein, 10 aa, Artificial Sequence
  Description of Artificial Sequence: Synthetic peptide
  Seed: ILDTAGKEEY (NRAS Q61K)
IVDTAGKEEF

SEQ ID NO: 13292 - protein, 10 aa, Artificial Sequence
  Description of Artificial Sequence: Synthetic peptide
  Seed: ILDTAGKEEY (NRAS Q61K)
IVDTAGKEEH

SEQ ID NO: 13293 - protein, 10 aa, Artificial Sequence
  Description of Artificial Sequence: Synthetic peptide
  Seed: ILDTAGKEEY (NRAS Q61K)
IVDTAGKEEI

SEQ ID NO: 13294 - protein, 10 aa, Artificial Sequence
  Description of Artificial Sequence: Synthetic peptide
  Seed: ILDTAGKEEY (NRAS Q61K)
IVDTAGKEEK

SEQ ID NO: 13295 - protein, 10 aa, Artificial Sequence
  Description of Artificial Sequence: Synthetic peptide
  Seed: ILDTAGKEEY (NRAS Q61K)
IVDTAGKEEL

SEQ ID NO: 13296 - protein, 10 aa, Artificial Sequence
  Description of Artificial Sequence: Synthetic peptide
  Seed: ILDTAGKEEY (NRAS Q61K)
IVDTAGKEEM

SEQ ID NO: 13297 - protein, 10 aa, Artificial Sequence
  Description of Artificial Sequence: Synthetic peptide
  Seed: ILDTAGKEEY (NRAS Q61K)
IVDTAGKEEQ

SEQ ID NO: 13298 - protein, 10 aa, Artificial Sequence
  Description of Artificial Sequence: Synthetic peptide
  Seed: ILDTAGKEEY (NRAS Q61K)
IVDTAGKEER

SEQ ID NO: 13299 - protein, 10 aa, Artificial Sequence
  Description of Artificial Sequence: Synthetic peptide
  Seed: ILDTAGKEEY (NRAS Q61K)
IVDTAGKEET

SEQ ID NO: 13300 - protein, 10 aa, Artificial Sequence
  Description of Artificial Sequence: Synthetic peptide
  Seed: ILDTAGKEEY (NRAS Q61K)
IVDTAGKEEV

SEQ ID NO: 13301 - protein, 10 aa, Artificial Sequence
  Description of Artificial Sequence: Synthetic peptide
  Seed: ILDTAGKEEY (NRAS Q61K)
IVDTAGKEEW

SEQ ID NO: 13302 - protein, 10 aa, Artificial Sequence
  Description of Artificial Sequence: Synthetic peptide
  Seed: ILDTAGKEEY (NRAS Q61K)
IWDTAGKEEA

SEQ ID NO: 13303 - protein, 10 aa, Artificial Sequence
  Description of Artificial Sequence: Synthetic peptide
  Seed: ILDTAGKEEY (NRAS Q61K)
IWDTAGKEEC

SEQ ID NO: 13304 - protein, 10 aa, Artificial Sequence
  Description of Artificial Sequence: Synthetic peptide
  Seed: ILDTAGKEEY (NRAS Q61K)
IWDTAGKEEF

SEQ ID NO: 13305 - protein, 10 aa, Artificial Sequence
  Description of Artificial Sequence: Synthetic peptide
  Seed: ILDTAGKEEY (NRAS Q61K)
IWDTAGKEEI

SEQ ID NO: 13306 - protein, 10 aa, Artificial Sequence
  Description of Artificial Sequence: Synthetic peptide
  Seed: ILDTAGKEEY (NRAS Q61K)
IWDTAGKEEK

SEQ ID NO: 13307 - protein, 10 aa, Artificial Sequence
  Description of Artificial Sequence: Synthetic peptide
  Seed: ILDTAGKEEY (NRAS Q61K)
IWDTAGKEEL

SEQ ID NO: 13308 - protein, 10 aa, Artificial Sequence
  Description of Artificial Sequence: Synthetic peptide
  Seed: ILDTAGKEEY (NRAS Q61K)
IWDTAGKEEM

SEQ ID NO: 13309 - protein, 10 aa, Artificial Sequence
  Description of Artificial Sequence: Synthetic peptide
  Seed: ILDTAGKEEY (NRAS Q61K)
IWDTAGKEET

SEQ ID NO: 13310 - protein, 10 aa, Artificial Sequence
  Description of Artificial Sequence: Synthetic peptide
  Seed: ILDTAGKEEY (NRAS Q61K)
IWDTAGKEEV

SEQ ID NO: 13311 - protein, 10 aa, Artificial Sequence
  Description of Artificial Sequence: Synthetic peptide
  Seed: ILDTAGKEEY (NRAS Q61K)
IWDTAGKEEW

SEQ ID NO: 13312 - protein, 10 aa, Artificial Sequence
  Description of Artificial Sequence: Synthetic peptide
  Seed: ILDTAGKEEY (NRAS Q61K)
IWDTAGKEEY

SEQ ID NO: 13313 - protein, 10 aa, Artificial Sequence
  Description of Artificial Sequence: Synthetic peptide
  Seed: ILDTAGKEEY (NRAS Q61K)
IYDTAGKEEA

SEQ ID NO: 13314 - protein, 10 aa, Artificial Sequence
  Description of Artificial Sequence: Synthetic peptide
  Seed: ILDTAGKEEY (NRAS Q61K)
IYDTAGKEEC

SEQ ID NO: 13315 - protein, 10 aa, Artificial Sequence
  Description of Artificial Sequence: Synthetic peptide
  Seed: ILDTAGKEEY (NRAS Q61K)
IYDTAGKEEF

SEQ ID NO: 13316 - protein, 10 aa, Artificial Sequence
  Description of Artificial Sequence: Synthetic peptide
  Seed: ILDTAGKEEY (NRAS Q61K)
IYDTAGKEEI

SEQ ID NO: 13317 - protein, 10 aa, Artificial Sequence
  Description of Artificial Sequence: Synthetic peptide
  Seed: ILDTAGKEEY (NRAS Q61K)
IYDTAGKEEK

SEQ ID NO: 13318 - protein, 10 aa, Artificial Sequence
  Description of Artificial Sequence: Synthetic peptide
  Seed: ILDTAGKEEY (NRAS Q61K)
IYDTAGKEEL

SEQ ID NO: 13319 - protein, 10 aa, Artificial Sequence
  Description of Artificial Sequence: Synthetic peptide
  Seed: ILDTAGKEEY (NRAS Q61K)
IYDTAGKEEM

SEQ ID NO: 13320 - protein, 10 aa, Artificial Sequence
  Description of Artificial Sequence: Synthetic peptide
  Seed: ILDTAGKEEY (NRAS Q61K)
IYDTAGKEER

SEQ ID NO: 13321 - protein, 10 aa, Artificial Sequence
  Description of Artificial Sequence: Synthetic peptide
  Seed: ILDTAGKEEY (NRAS Q61K)
IYDTAGKEET

SEQ ID NO: 13322 - protein, 10 aa, Artificial Sequence
  Description of Artificial Sequence: Synthetic peptide
  Seed: ILDTAGKEEY (NRAS Q61K)
IYDTAGKEEV

SEQ ID NO: 13323 - protein, 10 aa, Artificial Sequence
  Description of Artificial Sequence: Synthetic peptide
  Seed: ILDTAGKEEY (NRAS Q61K)
IYDTAGKEEW

SEQ ID NO: 13324 - protein, 10 aa, Artificial Sequence
  Description of Artificial Sequence: Synthetic peptide
  Seed: ILDTAGKEEY (NRAS Q61K)
IYDTAGKEEY

SEQ ID NO: 13325 - protein, 11 aa, Artificial Sequence
  Description of Artificial Sequence: Synthetic peptide
  Seed: KEEYSAMRDQY (NRAS Q61K)
KDEYSAMRDQW

SEQ ID NO: 13326 - protein, 11 aa, Artificial Sequence
  Description of Artificial Sequence: Synthetic peptide
  Seed: KEEYSAMRDQY (NRAS Q61K)
KEEYSAMRDQF

SEQ ID NO: 13327 - protein, 11 aa, Artificial Sequence
  Description of Artificial Sequence: Synthetic peptide
  Seed: KEEYSAMRDQY (NRAS Q61K)
KEEYSAMRDQL

SEQ ID NO: 13328 - protein, 11 aa, Artificial Sequence
  Description of Artificial Sequence: Synthetic peptide
  Seed: KEEYSAMRDQY (NRAS Q61K)
KEEYSAMRDQM

SEQ ID NO: 13329 - protein, 11 aa, Artificial Sequence
  Description of Artificial Sequence: Synthetic peptide
  Seed: KEEYSAMRDQY (NRAS Q61K)
KEEYSAMRDQW

SEQ ID NO: 13330 - protein, 11 aa, Artificial Sequence
  Description of Artificial Sequence: Synthetic peptide
  Seed: KEEYSAMRDQY (NRAS Q61K)
KQEYSAMRDQW

SEQ ID NO: 13331 - protein, 9 aa, Artificial Sequence
  Description of Artificial Sequence: Synthetic peptide
  Seed: LDTAGKEEY (NRAS Q61K)
LATAGKEEF

SEQ ID NO: 13332 - protein, 9 aa, Artificial Sequence
  Description of Artificial Sequence: Synthetic peptide
  Seed: LDTAGKEEY (NRAS Q61K)
LATAGKEEK

SEQ ID NO: 13333 - protein, 9 aa, Artificial Sequence
  Description of Artificial Sequence: Synthetic peptide
  Seed: LDTAGKEEY (NRAS Q61K)
LATAGKEEL

SEQ ID NO: 13334 - protein, 9 aa, Artificial Sequence
  Description of Artificial Sequence: Synthetic peptide
  Seed: LDTAGKEEY (NRAS Q61K)
LATAGKEEM

SEQ ID NO: 13335 - protein, 9 aa, Artificial Sequence
  Description of Artificial Sequence: Synthetic peptide
  Seed: LDTAGKEEY (NRAS Q61K)
LATAGKEEY

SEQ ID NO: 13336 - protein, 9 aa, Artificial Sequence
  Description of Artificial Sequence: Synthetic peptide
  Seed: LDTAGKEEY (NRAS Q61K)
LCTAGKEEY

SEQ ID NO: 13337 - protein, 9 aa, Artificial Sequence
  Description of Artificial Sequence: Synthetic peptide
  Seed: LDTAGKEEY (NRAS Q61K)
LDTAGKEEF

SEQ ID NO: 13338 - protein, 9 aa, Artificial Sequence
  Description of Artificial Sequence: Synthetic peptide
  Seed: LDTAGKEEY (NRAS Q61K)
LDTAGKEEI

SEQ ID NO: 13339 - protein, 9 aa, Artificial Sequence
  Description of Artificial Sequence: Synthetic peptide
  Seed: LDTAGKEEY (NRAS Q61K)
LDTAGKEEK

SEQ ID NO: 13340 - protein, 9 aa, Artificial Sequence
  Description of Artificial Sequence: Synthetic peptide
  Seed: LDTAGKEEY (NRAS Q61K)
LDTAGKEEL

SEQ ID NO: 13341 - protein, 9 aa, Artificial Sequence
  Description of Artificial Sequence: Synthetic peptide
  Seed: LDTAGKEEY (NRAS Q61K)
LDTAGKEEM

SEQ ID NO: 13342 - protein, 9 aa, Artificial Sequence
  Description of Artificial Sequence: Synthetic peptide
  Seed: LDTAGKEEY (NRAS Q61K)
LDTAGKEEV

SEQ ID NO: 13343 - protein, 9 aa, Artificial Sequence
  Description of Artificial Sequence: Synthetic peptide
  Seed: LDTAGKEEY (NRAS Q61K)
LDTAGKEEW

SEQ ID NO: 13344 - protein, 9 aa, Artificial Sequence
  Description of Artificial Sequence: Synthetic peptide
  Seed: LDTAGKEEY (NRAS Q61K)
LETAGKEEA

SEQ ID NO: 13345 - protein, 9 aa, Artificial Sequence
  Description of Artificial Sequence: Synthetic peptide
  Seed: LDTAGKEEY (NRAS Q61K)
LETAGKEEC

SEQ ID NO: 13346 - protein, 9 aa, Artificial Sequence
  Description of Artificial Sequence: Synthetic peptide
  Seed: LDTAGKEEY (NRAS Q61K)
LETAGKEEF

SEQ ID NO: 13347 - protein, 9 aa, Artificial Sequence
  Description of Artificial Sequence: Synthetic peptide
  Seed: LDTAGKEEY (NRAS Q61K)
LETAGKEEH

SEQ ID NO: 13348 - protein, 9 aa, Artificial Sequence
  Description of Artificial Sequence: Synthetic peptide
  Seed: LDTAGKEEY (NRAS Q61K)
LETAGKEEI

SEQ ID NO: 13349 - protein, 9 aa, Artificial Sequence
  Description of Artificial Sequence: Synthetic peptide
  Seed: LDTAGKEEY (NRAS Q61K)
LETAGKEEK

SEQ ID NO: 13350 - protein, 9 aa, Artificial Sequence
  Description of Artificial Sequence: Synthetic peptide
  Seed: LDTAGKEEY (NRAS Q61K)
LETAGKEEL

SEQ ID NO: 13351 - protein, 9 aa, Artificial Sequence
  Description of Artificial Sequence: Synthetic peptide
  Seed: LDTAGKEEY (NRAS Q61K)
LETAGKEER

SEQ ID NO: 13352 - protein, 9 aa, Artificial Sequence
  Description of Artificial Sequence: Synthetic peptide
  Seed: LDTAGKEEY (NRAS Q61K)
LETAGKEEV

SEQ ID NO: 13353 - protein, 9 aa, Artificial Sequence
  Description of Artificial Sequence: Synthetic peptide
  Seed: LDTAGKEEY (NRAS Q61K)
LETAGKEEY

SEQ ID NO: 13354 - protein, 9 aa, Artificial Sequence
  Description of Artificial Sequence: Synthetic peptide
  Seed: LDTAGKEEY (NRAS Q61K)
LFTAGKEEF

SEQ ID NO: 13355 - protein, 9 aa, Artificial Sequence
  Description of Artificial Sequence: Synthetic peptide
  Seed: LDTAGKEEY (NRAS Q61K)
LFTAGKEEY

SEQ ID NO: 13356 - protein, 9 aa, Artificial Sequence
  Description of Artificial Sequence: Synthetic peptide
  Seed: LDTAGKEEY (NRAS Q61K)
LGTAGKEEF

SEQ ID NO: 13357 - protein, 9 aa, Artificial Sequence
  Description of Artificial Sequence: Synthetic peptide
  Seed: LDTAGKEEY (NRAS Q61K)
LGTAGKEEY

SEQ ID NO: 13358 - protein, 9 aa, Artificial Sequence
  Description of Artificial Sequence: Synthetic peptide
  Seed: LDTAGKEEY (NRAS Q61K)
LHTAGKEEY

SEQ ID NO: 13359 - protein, 9 aa, Artificial Sequence
  Description of Artificial Sequence: Synthetic peptide
  Seed: LDTAGKEEY (NRAS Q61K)
LITAGKEEF

SEQ ID NO: 13360 - protein, 9 aa, Artificial Sequence
  Description of Artificial Sequence: Synthetic peptide
  Seed: LDTAGKEEY (NRAS Q61K)
LITAGKEEK

SEQ ID NO: 13361 - protein, 9 aa, Artificial Sequence
  Description of Artificial Sequence: Synthetic peptide
  Seed: LDTAGKEEY (NRAS Q61K)
LITAGKEEL

SEQ ID NO: 13362 - protein, 9 aa, Artificial Sequence
  Description of Artificial Sequence: Synthetic peptide
  Seed: LDTAGKEEY (NRAS Q61K)
LITAGKEEM

SEQ ID NO: 13363 - protein, 9 aa, Artificial Sequence
  Description of Artificial Sequence: Synthetic peptide
  Seed: LDTAGKEEY (NRAS Q61K)
LITAGKEEY

SEQ ID NO: 13364 - protein, 9 aa, Artificial Sequence
  Description of Artificial Sequence: Synthetic peptide
  Seed: LDTAGKEEY (NRAS Q61K)
LKTAGKEEY

SEQ ID NO: 13365 - protein, 9 aa, Artificial Sequence
  Description of Artificial Sequence: Synthetic peptide
  Seed: LDTAGKEEY (NRAS Q61K)
LLTAGKEEF

SEQ ID NO: 13366 - protein, 9 aa, Artificial Sequence
  Description of Artificial Sequence: Synthetic peptide
  Seed: LDTAGKEEY (NRAS Q61K)
LLTAGKEEK

SEQ ID NO: 13367 - protein, 9 aa, Artificial Sequence
  Description of Artificial Sequence: Synthetic peptide
  Seed: LDTAGKEEY (NRAS Q61K)
LLTAGKEEL

SEQ ID NO: 13368 - protein, 9 aa, Artificial Sequence
  Description of Artificial Sequence: Synthetic peptide
  Seed: LDTAGKEEY (NRAS Q61K)
LLTAGKEEM

SEQ ID NO: 13369 - protein, 9 aa, Artificial Sequence
  Description of Artificial Sequence: Synthetic peptide
  Seed: LDTAGKEEY (NRAS Q61K)
LLTAGKEEY

SEQ ID NO: 13370 - protein, 9 aa, Artificial Sequence
  Description of Artificial Sequence: Synthetic peptide
  Seed: LDTAGKEEY (NRAS Q61K)
LMTAGKEEF

SEQ ID NO: 13371 - protein, 9 aa, Artificial Sequence
  Description of Artificial Sequence: Synthetic peptide
  Seed: LDTAGKEEY (NRAS Q61K)
LMTAGKEEL

SEQ ID NO: 13372 - protein, 9 aa, Artificial Sequence
  Description of Artificial Sequence: Synthetic peptide
  Seed: LDTAGKEEY (NRAS Q61K)
LMTAGKEEM

SEQ ID NO: 13373 - protein, 9 aa, Artificial Sequence
  Description of Artificial Sequence: Synthetic peptide
  Seed: LDTAGKEEY (NRAS Q61K)
LMTAGKEEW

SEQ ID NO: 13374 - protein, 9 aa, Artificial Sequence
  Description of Artificial Sequence: Synthetic peptide
  Seed: LDTAGKEEY (NRAS Q61K)
LMTAGKEEY

SEQ ID NO: 13375 - protein, 9 aa, Artificial Sequence
  Description of Artificial Sequence: Synthetic peptide
  Seed: LDTAGKEEY (NRAS Q61K)
LNTAGKEEF

SEQ ID NO: 13376 - protein, 9 aa, Artificial Sequence
  Description of Artificial Sequence: Synthetic peptide
  Seed: LDTAGKEEY (NRAS Q61K)
LNTAGKEEY

SEQ ID NO: 13377 - protein, 9 aa, Artificial Sequence
  Description of Artificial Sequence: Synthetic peptide
  Seed: LDTAGKEEY (NRAS Q61K)
LPTAGKEEF

SEQ ID NO: 13378 - protein, 9 aa, Artificial Sequence
  Description of Artificial Sequence: Synthetic peptide
  Seed: LDTAGKEEY (NRAS Q61K)
LPTAGKEEL

SEQ ID NO: 13379 - protein, 9 aa, Artificial Sequence
  Description of Artificial Sequence: Synthetic peptide
  Seed: LDTAGKEEY (NRAS Q61K)
LPTAGKEEM

SEQ ID NO: 13380 - protein, 9 aa, Artificial Sequence
  Description of Artificial Sequence: Synthetic peptide
  Seed: LDTAGKEEY (NRAS Q61K)
LPTAGKEEY

SEQ ID NO: 13381 - protein, 9 aa, Artificial Sequence
  Description of Artificial Sequence: Synthetic peptide
  Seed: LDTAGKEEY (NRAS Q61K)
LQTAGKEEF

SEQ ID NO: 13382 - protein, 9 aa, Artificial Sequence
  Description of Artificial Sequence: Synthetic peptide
  Seed: LDTAGKEEY (NRAS Q61K)
LQTAGKEEI

SEQ ID NO: 13383 - protein, 9 aa, Artificial Sequence
  Description of Artificial Sequence: Synthetic peptide
  Seed: LDTAGKEEY (NRAS Q61K)
LQTAGKEEK

SEQ ID NO: 13384 - protein, 9 aa, Artificial Sequence
  Description of Artificial Sequence: Synthetic peptide
  Seed: LDTAGKEEY (NRAS Q61K)
LQTAGKEEL

SEQ ID NO: 13385 - protein, 9 aa, Artificial Sequence
  Description of Artificial Sequence: Synthetic peptide
  Seed: LDTAGKEEY (NRAS Q61K)
LQTAGKEEM

SEQ ID NO: 13386 - protein, 9 aa, Artificial Sequence
  Description of Artificial Sequence: Synthetic peptide
  Seed: LDTAGKEEY (NRAS Q61K)
LQTAGKEEV

SEQ ID NO: 13387 - protein, 9 aa, Artificial Sequence
  Description of Artificial Sequence: Synthetic peptide
  Seed: LDTAGKEEY (NRAS Q61K)
LQTAGKEEW

SEQ ID NO: 13388 - protein, 9 aa, Artificial Sequence
  Description of Artificial Sequence: Synthetic peptide
  Seed: LDTAGKEEY (NRAS Q61K)
LQTAGKEEY

SEQ ID NO: 13389 - protein, 9 aa, Artificial Sequence
  Description of Artificial Sequence: Synthetic peptide
  Seed: LDTAGKEEY (NRAS Q61K)
LRTAGKEEY

SEQ ID NO: 13390 - protein, 9 aa, Artificial Sequence
  Description of Artificial Sequence: Synthetic peptide
  Seed: LDTAGKEEY (NRAS Q61K)
LSTAGKEEF

SEQ ID NO: 13391 - protein, 9 aa, Artificial Sequence
  Description of Artificial Sequence: Synthetic peptide
  Seed: LDTAGKEEY (NRAS Q61K)
LSTAGKEEK

SEQ ID NO: 13392 - protein, 9 aa, Artificial Sequence
  Description of Artificial Sequence: Synthetic peptide
  Seed: LDTAGKEEY (NRAS Q61K)
LSTAGKEEM

SEQ ID NO: 13393 - protein, 9 aa, Artificial Sequence
  Description of Artificial Sequence: Synthetic peptide
  Seed: LDTAGKEEY (NRAS Q61K)
LSTAGKEEY

SEQ ID NO: 13394 - protein, 9 aa, Artificial Sequence
  Description of Artificial Sequence: Synthetic peptide
  Seed: LDTAGKEEY (NRAS Q61K)
LTTAGKEEF

SEQ ID NO: 13395 - protein, 9 aa, Artificial Sequence
  Description of Artificial Sequence: Synthetic peptide
  Seed: LDTAGKEEY (NRAS Q61K)
LTTAGKEEK

SEQ ID NO: 13396 - protein, 9 aa, Artificial Sequence
  Description of Artificial Sequence: Synthetic peptide
  Seed: LDTAGKEEY (NRAS Q61K)
LTTAGKEEM

SEQ ID NO: 13397 - protein, 9 aa, Artificial Sequence
  Description of Artificial Sequence: Synthetic peptide
  Seed: LDTAGKEEY (NRAS Q61K)
LTTAGKEEY

SEQ ID NO: 13398 - protein, 9 aa, Artificial Sequence
  Description of Artificial Sequence: Synthetic peptide
  Seed: LDTAGKEEY (NRAS Q61K)
LVTAGKEEF

SEQ ID NO: 13399 - protein, 9 aa, Artificial Sequence
  Description of Artificial Sequence: Synthetic peptide
  Seed: LDTAGKEEY (NRAS Q61K)
LVTAGKEEK

SEQ ID NO: 13400 - protein, 9 aa, Artificial Sequence
  Description of Artificial Sequence: Synthetic peptide
  Seed: LDTAGKEEY (NRAS Q61K)
LVTAGKEEL

SEQ ID NO: 13401 - protein, 9 aa, Artificial Sequence
  Description of Artificial Sequence: Synthetic peptide
  Seed: LDTAGKEEY (NRAS Q61K)
LVTAGKEEM

SEQ ID NO: 13402 - protein, 9 aa, Artificial Sequence
  Description of Artificial Sequence: Synthetic peptide
  Seed: LDTAGKEEY (NRAS Q61K)
LVTAGKEEY

SEQ ID NO: 13403 - protein, 9 aa, Artificial Sequence
  Description of Artificial Sequence: Synthetic peptide
  Seed: LDTAGKEEY (NRAS Q61K)
LWTAGKEEY

SEQ ID NO: 13404 - protein, 9 aa, Artificial Sequence
  Description of Artificial Sequence: Synthetic peptide
  Seed: LDTAGKEEY (NRAS Q61K)
LYTAGKEEF

SEQ ID NO: 13405 - protein, 9 aa, Artificial Sequence
  Description of Artificial Sequence: Synthetic peptide
  Seed: LDTAGKEEY (NRAS Q61K)
LYTAGKEEY

SEQ ID NO: 13406 - protein, 10 aa, Artificial Sequence
  Description of Artificial Sequence: Synthetic peptide
  Seed: TAGKEEYSAM (NRAS Q61K)
TAGKEEYSAF

SEQ ID NO: 13407 - protein, 10 aa, Artificial Sequence
  Description of Artificial Sequence: Synthetic peptide
  Seed: TAGKEEYSAM (NRAS Q61K)
TAGKEEYSAL

SEQ ID NO: 13408 - protein, 10 aa, Artificial Sequence
  Description of Artificial Sequence: Synthetic peptide
  Seed: TAGKEEYSAM (NRAS Q61K)
TAGKEEYSAY

SEQ ID NO: 13409 - protein, 11 aa, Artificial Sequence
  Description of Artificial Sequence: Synthetic peptide
  Seed: TAGKEEYSAMR (NRAS Q61K)
TFGKEEYSAMR

SEQ ID NO: 13410 - protein, 10 aa, Artificial Sequence
  Description of Artificial Sequence: Synthetic peptide
  Seed: TAGKEEYSAM (NRAS Q61K)
TIGKEEYSAF

SEQ ID NO: 13411 - protein, 11 aa, Artificial Sequence
  Description of Artificial Sequence: Synthetic peptide
  Seed: TAGKEEYSAMR (NRAS Q61K)
TIGKEEYSAMR

SEQ ID NO: 13412 - protein, 10 aa, Artificial Sequence
  Description of Artificial Sequence: Synthetic peptide
  Seed: TAGKEEYSAM (NRAS Q61K)
TIGKEEYSAY

SEQ ID NO: 13413 - protein, 10 aa, Artificial Sequence
  Description of Artificial Sequence: Synthetic peptide
  Seed: TAGKEEYSAM (NRAS Q61K)
TLGKEEYSAY

SEQ ID NO: 13414 - protein, 10 aa, Artificial Sequence
  Description of Artificial Sequence: Synthetic peptide
  Seed: TAGKEEYSAM (NRAS Q61K)
TMGKEEYSAY

SEQ ID NO: 13415 - protein, 10 aa, Artificial Sequence
  Description of Artificial Sequence: Synthetic peptide
  Seed: TAGKEEYSAM (NRAS Q61K)
TQGKEEYSAY

SEQ ID NO: 13416 - protein, 10 aa, Artificial Sequence
  Description of Artificial Sequence: Synthetic peptide
  Seed: TAGKEEYSAM (NRAS Q61K)
TSGKEEYSAF

SEQ ID NO: 13417 - protein, 10 aa, Artificial Sequence
  Description of Artificial Sequence: Synthetic peptide
  Seed: TAGKEEYSAM (NRAS Q61K)
TSGKEEYSAY

SEQ ID NO: 13418 - protein, 10 aa, Artificial Sequence
  Description of Artificial Sequence: Synthetic peptide
  Seed: TAGKEEYSAM (NRAS Q61K)
TTGKEEYSAF

SEQ ID NO: 13419 - protein, 11 aa, Artificial Sequence
  Description of Artificial Sequence: Synthetic peptide
  Seed: TAGKEEYSAMR (NRAS Q61K)
TTGKEEYSAMR

SEQ ID NO: 13420 - protein, 10 aa, Artificial Sequence
  Description of Artificial Sequence: Synthetic peptide
  Seed: TAGKEEYSAM (NRAS Q61K)
TTGKEEYSAY

SEQ ID NO: 13421 - protein, 10 aa, Artificial Sequence
  Description of Artificial Sequence: Synthetic peptide
  Seed: TAGKEEYSAM (NRAS Q61K)
TVGKEEYSAF

SEQ ID NO: 13422 - protein, 11 aa, Artificial Sequence
  Description of Artificial Sequence: Synthetic peptide
  Seed: TAGKEEYSAMR (NRAS Q61K)
TVGKEEYSAMK

SEQ ID NO: 13423 - protein, 11 aa, Artificial Sequence
  Description of Artificial Sequence: Synthetic peptide
  Seed: TAGKEEYSAMR (NRAS Q61K)
TVGKEEYSAMR

SEQ ID NO: 13424 - protein, 10 aa, Artificial Sequence
  Description of Artificial Sequence: Synthetic peptide
  Seed: TAGKEEYSAM (NRAS Q61K)
TVGKEEYSAY

SEQ ID NO: 13425 - protein, 11 aa, Artificial Sequence
  Description of Artificial Sequence: Synthetic peptide
  Seed: TAGKEEYSAMR (NRAS Q61K)
TYGKEEYSAMR

SEQ ID NO: 13426 - protein, 10 aa, Homo sapiens
  Native (NRAS Q61K)
AGKEEYSAMR

SEQ ID NO: 13427 - protein, 10 aa, Homo sapiens
  Native (NRAS Q61K)
ILDTAGKEEY

SEQ ID NO: 13428 - protein, 9 aa, Homo sapiens
  Native (NRAS Q61K)
AGKEEYSAM

SEQ ID NO: 13429 - protein, 11 aa, Homo sapiens
  Native (NRAS Q61K)
DILDTAGKEEY

SEQ ID NO: 13430 - protein, 11 aa, Homo sapiens
  Native (NRAS Q61K)
DTAGKEEYSAM

SEQ ID NO: 13431 - protein, 11 aa, Homo sapiens
  Native (NRAS Q61K)
KEEYSAMRDQY

SEQ ID NO: 13432 - protein, 9 aa, Homo sapiens
  Native (NRAS Q61K)
LDTAGKEEY

SEQ ID NO: 13433 - protein, 10 aa, Homo sapiens
  Native (NRAS Q61K)
TAGKEEYSAM

SEQ ID NO: 13434 - protein, 11 aa, Homo sapiens
  Native (NRAS Q61K)
TAGKEEYSAMR

SEQ ID NO: 13435 - protein, 9 aa, Artificial Sequence
  Description of Artificial Sequence: Synthetic peptide
  Seed: AGLEEYSAM (NRAS Q61L)
AALEEYSAF

SEQ ID NO: 13436 - protein, 9 aa, Artificial Sequence
  Description of Artificial Sequence: Synthetic peptide
  Seed: AGLEEYSAM (NRAS Q61L)
AALEEYSAM

SEQ ID NO: 13437 - protein, 10 aa, Artificial Sequence
  Description of Artificial Sequence: Synthetic peptide
  Seed: AGLEEYSAMR (NRAS Q61L)
AALEEYSAMR

SEQ ID NO: 13438 - protein, 9 aa, Artificial Sequence
  Description of Artificial Sequence: Synthetic peptide
  Seed: AGLEEYSAM (NRAS Q61L)
AALEEYSAY

SEQ ID NO: 13439 - protein, 9 aa, Artificial Sequence
  Description of Artificial Sequence: Synthetic peptide
  Seed: AGLEEYSAM (NRAS Q61L)
ACLEEYSAF

SEQ ID NO: 13440 - protein, 9 aa, Artificial Sequence
  Description of Artificial Sequence: Synthetic peptide
  Seed: AGLEEYSAM (NRAS Q61L)
ACLEEYSAY

SEQ ID NO: 13441 - protein, 9 aa, Artificial Sequence
  Description of Artificial Sequence: Synthetic peptide
  Seed: AGLEEYSAM (NRAS Q61L)
AELEEYSAF

SEQ ID NO: 13442 - protein, 9 aa, Artificial Sequence
  Description of Artificial Sequence: Synthetic peptide
  Seed: AGLEEYSAM (NRAS Q61L)
AELEEYSAM

SEQ ID NO: 13443 - protein, 9 aa, Artificial Sequence
  Description of Artificial Sequence: Synthetic peptide
  Seed: AGLEEYSAM (NRAS Q61L)
AELEEYSAY

SEQ ID NO: 13444 - protein, 9 aa, Artificial Sequence
  Description of Artificial Sequence: Synthetic peptide
  Seed: AGLEEYSAM (NRAS Q61L)
AFLEEYSAF

SEQ ID NO: 13445 - protein, 10 aa, Artificial Sequence
  Description of Artificial Sequence: Synthetic peptide
  Seed: AGLEEYSAMR (NRAS Q61L)
AFLEEYSAMK

SEQ ID NO: 13446 - protein, 10 aa, Artificial Sequence
  Description of Artificial Sequence: Synthetic peptide
  Seed: AGLEEYSAMR (NRAS Q61L)
AFLEEYSAMR

SEQ ID NO: 13447 - protein, 9 aa, Artificial Sequence
  Description of Artificial Sequence: Synthetic peptide
  Seed: AGLEEYSAM (NRAS Q61L)
AFLEEYSAY

SEQ ID NO: 13448 - protein, 9 aa, Artificial Sequence
  Description of Artificial Sequence: Synthetic peptide
  Seed: AGLEEYSAM (NRAS Q61L)
AGLEEYSAF

SEQ ID NO: 13449 - protein, 9 aa, Artificial Sequence
  Description of Artificial Sequence: Synthetic peptide
  Seed: AGLEEYSAM (NRAS Q61L)
AGLEEYSAY

SEQ ID NO: 13450 - protein, 9 aa, Artificial Sequence
  Description of Artificial Sequence: Synthetic peptide
  Seed: AGLEEYSAM (NRAS Q61L)
AHLEEYSAF

SEQ ID NO: 13451 - protein, 9 aa, Artificial Sequence
  Description of Artificial Sequence: Synthetic peptide
  Seed: AGLEEYSAM (NRAS Q61L)
AHLEEYSAL

SEQ ID NO: 13452 - protein, 9 aa, Artificial Sequence
  Description of Artificial Sequence: Synthetic peptide
  Seed: AGLEEYSAM (NRAS Q61L)
AHLEEYSAM

SEQ ID NO: 13453 - protein, 9 aa, Artificial Sequence
  Description of Artificial Sequence: Synthetic peptide
  Seed: AGLEEYSAM (NRAS Q61L)
AHLEEYSAY

SEQ ID NO: 13454 - protein, 9 aa, Artificial Sequence
  Description of Artificial Sequence: Synthetic peptide
  Seed: AGLEEYSAM (NRAS Q61L)
AILEEYSAF

SEQ ID NO: 13455 - protein, 9 aa, Artificial Sequence
  Description of Artificial Sequence: Synthetic peptide
  Seed: AGLEEYSAM (NRAS Q61L)
AILEEYSAM

SEQ ID NO: 13456 - protein, 10 aa, Artificial Sequence
  Description of Artificial Sequence: Synthetic peptide
  Seed: AGLEEYSAMR (NRAS Q61L)
AILEEYSAMR

SEQ ID NO: 13457 - protein, 9 aa, Artificial Sequence
  Description of Artificial Sequence: Synthetic peptide
  Seed: AGLEEYSAM (NRAS Q61L)
AILEEYSAY

SEQ ID NO: 13458 - protein, 9 aa, Artificial Sequence
  Description of Artificial Sequence: Synthetic peptide
  Seed: AGLEEYSAM (NRAS Q61L)
AKLEEYSAF

SEQ ID NO: 13459 - protein, 9 aa, Artificial Sequence
  Description of Artificial Sequence: Synthetic peptide
  Seed: AGLEEYSAM (NRAS Q61L)
AKLEEYSAH

SEQ ID NO: 13460 - protein, 9 aa, Artificial Sequence
  Description of Artificial Sequence: Synthetic peptide
  Seed: AGLEEYSAM (NRAS Q61L)
AKLEEYSAI

SEQ ID NO: 13461 - protein, 9 aa, Artificial Sequence
  Description of Artificial Sequence: Synthetic peptide
  Seed: AGLEEYSAM (NRAS Q61L)
AKLEEYSAL

SEQ ID NO: 13462 - protein, 9 aa, Artificial Sequence
  Description of Artificial Sequence: Synthetic peptide
  Seed: AGLEEYSAM (NRAS Q61L)
AKLEEYSAM

SEQ ID NO: 13463 - protein, 9 aa, Artificial Sequence
  Description of Artificial Sequence: Synthetic peptide
  Seed: AGLEEYSAM (NRAS Q61L)
AKLEEYSAV

SEQ ID NO: 13464 - protein, 9 aa, Artificial Sequence
  Description of Artificial Sequence: Synthetic peptide
  Seed: AGLEEYSAM (NRAS Q61L)
AKLEEYSAW

SEQ ID NO: 13465 - protein, 9 aa, Artificial Sequence
  Description of Artificial Sequence: Synthetic peptide
  Seed: AGLEEYSAM (NRAS Q61L)
AKLEEYSAY

SEQ ID NO: 13466 - protein, 9 aa, Artificial Sequence
  Description of Artificial Sequence: Synthetic peptide
  Seed: AGLEEYSAM (NRAS Q61L)
ALLEEYSAF

SEQ ID NO: 13467 - protein, 9 aa, Artificial Sequence
  Description of Artificial Sequence: Synthetic peptide
  Seed: AGLEEYSAM (NRAS Q61L)
ALLEEYSAL

SEQ ID NO: 13468 - protein, 9 aa, Artificial Sequence
  Description of Artificial Sequence: Synthetic peptide
  Seed: AGLEEYSAM (NRAS Q61L)
ALLEEYSAM

SEQ ID NO: 13469 - protein, 10 aa, Artificial Sequence
  Description of Artificial Sequence: Synthetic peptide
  Seed: AGLEEYSAMR (NRAS Q61L)
ALLEEYSAMR

SEQ ID NO: 13470 - protein, 9 aa, Artificial Sequence
  Description of Artificial Sequence: Synthetic peptide
  Seed: AGLEEYSAM (NRAS Q61L)
ALLEEYSAY

SEQ ID NO: 13471 - protein, 9 aa, Artificial Sequence
  Description of Artificial Sequence: Synthetic peptide
  Seed: AGLEEYSAM (NRAS Q61L)
AMLEEYSAA

SEQ ID NO: 13472 - protein, 9 aa, Artificial Sequence
  Description of Artificial Sequence: Synthetic peptide
  Seed: AGLEEYSAM (NRAS Q61L)
AMLEEYSAF

SEQ ID NO: 13473 - protein, 9 aa, Artificial Sequence
  Description of Artificial Sequence: Synthetic peptide
  Seed: AGLEEYSAM (NRAS Q61L)
AMLEEYSAH

SEQ ID NO: 13474 - protein, 9 aa, Artificial Sequence
  Description of Artificial Sequence: Synthetic peptide
  Seed: AGLEEYSAM (NRAS Q61L)
AMLEEYSAI

SEQ ID NO: 13475 - protein, 9 aa, Artificial Sequence
  Description of Artificial Sequence: Synthetic peptide
  Seed: AGLEEYSAM (NRAS Q61L)
AMLEEYSAL

SEQ ID NO: 13476 - protein, 9 aa, Artificial Sequence
  Description of Artificial Sequence: Synthetic peptide
  Seed: AGLEEYSAM (NRAS Q61L)
AMLEEYSAM

SEQ ID NO: 13477 - protein, 10 aa, Artificial Sequence
  Description of Artificial Sequence: Synthetic peptide
  Seed: AGLEEYSAMR (NRAS Q61L)
AMLEEYSAMK

SEQ ID NO: 13478 - protein, 10 aa, Artificial Sequence
  Description of Artificial Sequence: Synthetic peptide
  Seed: AGLEEYSAMR (NRAS Q61L)
AMLEEYSAMR

SEQ ID NO: 13479 - protein, 9 aa, Artificial Sequence
  Description of Artificial Sequence: Synthetic peptide
  Seed: AGLEEYSAM (NRAS Q61L)
AMLEEYSAV

SEQ ID NO: 13480 - protein, 9 aa, Artificial Sequence
  Description of Artificial Sequence: Synthetic peptide
  Seed: AGLEEYSAM (NRAS Q61L)
AMLEEYSAW

SEQ ID NO: 13481 - protein, 9 aa, Artificial Sequence
  Description of Artificial Sequence: Synthetic peptide
  Seed: AGLEEYSAM (NRAS Q61L)
AMLEEYSAY

SEQ ID NO: 13482 - protein, 9 aa, Artificial Sequence
  Description of Artificial Sequence: Synthetic peptide
  Seed: AGLEEYSAM (NRAS Q61L)
ANLEEYSAF

SEQ ID NO: 13483 - protein, 9 aa, Artificial Sequence
  Description of Artificial Sequence: Synthetic peptide
  Seed: AGLEEYSAM (NRAS Q61L)
ANLEEYSAM

SEQ ID NO: 13484 - protein, 9 aa, Artificial Sequence
  Description of Artificial Sequence: Synthetic peptide
  Seed: AGLEEYSAM (NRAS Q61L)
ANLEEYSAY

SEQ ID NO: 13485 - protein, 9 aa, Artificial Sequence
  Description of Artificial Sequence: Synthetic peptide
  Seed: AGLEEYSAM (NRAS Q61L)
AQLEEYSAA

SEQ ID NO: 13486 - protein, 9 aa, Artificial Sequence
  Description of Artificial Sequence: Synthetic peptide
  Seed: AGLEEYSAM (NRAS Q61L)
AQLEEYSAG

SEQ ID NO: 13487 - protein, 9 aa, Artificial Sequence
  Description of Artificial Sequence: Synthetic peptide
  Seed: AGLEEYSAM (NRAS Q61L)
AQLEEYSAH

SEQ ID NO: 13488 - protein, 9 aa, Artificial Sequence
  Description of Artificial Sequence: Synthetic peptide
  Seed: AGLEEYSAM (NRAS Q61L)
AQLEEYSAI

SEQ ID NO: 13489 - protein, 9 aa, Artificial Sequence
  Description of Artificial Sequence: Synthetic peptide
  Seed: AGLEEYSAM (NRAS Q61L)
AQLEEYSAL

SEQ ID NO: 13490 - protein, 9 aa, Artificial Sequence
  Description of Artificial Sequence: Synthetic peptide
  Seed: AGLEEYSAM (NRAS Q61L)
AQLEEYSAM

SEQ ID NO: 13491 - protein, 10 aa, Artificial Sequence
  Description of Artificial Sequence: Synthetic peptide
  Seed: AGLEEYSAMR (NRAS Q61L)
AQLEEYSAMR

SEQ ID NO: 13492 - protein, 9 aa, Artificial Sequence
  Description of Artificial Sequence: Synthetic peptide
  Seed: AGLEEYSAM (NRAS Q61L)
AQLEEYSAV

SEQ ID NO: 13493 - protein, 9 aa, Artificial Sequence
  Description of Artificial Sequence: Synthetic peptide
  Seed: AGLEEYSAM (NRAS Q61L)
AQLEEYSAW

SEQ ID NO: 13494 - protein, 9 aa, Artificial Sequence
  Description of Artificial Sequence: Synthetic peptide
  Seed: AGLEEYSAM (NRAS Q61L)
AQLEEYSAY

SEQ ID NO: 13495 - protein, 9 aa, Artificial Sequence
  Description of Artificial Sequence: Synthetic peptide
  Seed: AGLEEYSAM (NRAS Q61L)
ARLEEYSAF

SEQ ID NO: 13496 - protein, 9 aa, Artificial Sequence
  Description of Artificial Sequence: Synthetic peptide
  Seed: AGLEEYSAM (NRAS Q61L)
ARLEEYSAL

SEQ ID NO: 13497 - protein, 9 aa, Artificial Sequence
  Description of Artificial Sequence: Synthetic peptide
  Seed: AGLEEYSAM (NRAS Q61L)
ARLEEYSAM

SEQ ID NO: 13498 - protein, 9 aa, Artificial Sequence
  Description of Artificial Sequence: Synthetic peptide
  Seed: AGLEEYSAM (NRAS Q61L)
ARLEEYSAY

SEQ ID NO: 13499 - protein, 9 aa, Artificial Sequence
  Description of Artificial Sequence: Synthetic peptide
  Seed: AGLEEYSAM (NRAS Q61L)
ASLEEYSAF

SEQ ID NO: 13500 - protein, 9 aa, Artificial Sequence
  Description of Artificial Sequence: Synthetic peptide
  Seed: AGLEEYSAM (NRAS Q61L)
ASLEEYSAL

SEQ ID NO: 13501 - protein, 9 aa, Artificial Sequence
  Description of Artificial Sequence: Synthetic peptide
  Seed: AGLEEYSAM (NRAS Q61L)
ASLEEYSAM

SEQ ID NO: 13502 - protein, 10 aa, Artificial Sequence
  Description of Artificial Sequence: Synthetic peptide
  Seed: AGLEEYSAMR (NRAS Q61L)
ASLEEYSAMR

SEQ ID NO: 13503 - protein, 9 aa, Artificial Sequence
  Description of Artificial Sequence: Synthetic peptide
  Seed: AGLEEYSAM (NRAS Q61L)
ASLEEYSAY

SEQ ID NO: 13504 - protein, 9 aa, Artificial Sequence
  Description of Artificial Sequence: Synthetic peptide
  Seed: AGLEEYSAM (NRAS Q61L)
ATLEEYSAM

SEQ ID NO: 13505 - protein, 10 aa, Artificial Sequence
  Description of Artificial Sequence: Synthetic peptide
  Seed: AGLEEYSAMR (NRAS Q61L)
ATLEEYSAMR

SEQ ID NO: 13506 - protein, 9 aa, Artificial Sequence
  Description of Artificial Sequence: Synthetic peptide
  Seed: AGLEEYSAM (NRAS Q61L)
ATLEEYSAY

SEQ ID NO: 13507 - protein, 9 aa, Artificial Sequence
  Description of Artificial Sequence: Synthetic peptide
  Seed: AGLEEYSAM (NRAS Q61L)
AVLEEYSAF

SEQ ID NO: 13508 - protein, 9 aa, Artificial Sequence
  Description of Artificial Sequence: Synthetic peptide
  Seed: AGLEEYSAM (NRAS Q61L)
AVLEEYSAM

SEQ ID NO: 13509 - protein, 10 aa, Artificial Sequence
  Description of Artificial Sequence: Synthetic peptide
  Seed: AGLEEYSAMR (NRAS Q61L)
AVLEEYSAMR

SEQ ID NO: 13510 - protein, 9 aa, Artificial Sequence
  Description of Artificial Sequence: Synthetic peptide
  Seed: AGLEEYSAM (NRAS Q61L)
AVLEEYSAY

SEQ ID NO: 13511 - protein, 9 aa, Artificial Sequence
  Description of Artificial Sequence: Synthetic peptide
  Seed: AGLEEYSAM (NRAS Q61L)
AWLEEYSAF

SEQ ID NO: 13512 - protein, 10 aa, Artificial Sequence
  Description of Artificial Sequence: Synthetic peptide
  Seed: AGLEEYSAMR (NRAS Q61L)
AWLEEYSAMK

SEQ ID NO: 13513 - protein, 10 aa, Artificial Sequence
  Description of Artificial Sequence: Synthetic peptide
  Seed: AGLEEYSAMR (NRAS Q61L)
AWLEEYSAMR

SEQ ID NO: 13514 - protein, 9 aa, Artificial Sequence
  Description of Artificial Sequence: Synthetic peptide
  Seed: AGLEEYSAM (NRAS Q61L)
AYLEEYSAF

SEQ ID NO: 13515 - protein, 9 aa, Artificial Sequence
  Description of Artificial Sequence: Synthetic peptide
  Seed: AGLEEYSAM (NRAS Q61L)
AYLEEYSAM

SEQ ID NO: 13516 - protein, 10 aa, Artificial Sequence
  Description of Artificial Sequence: Synthetic peptide
  Seed: AGLEEYSAMR (NRAS Q61L)
AYLEEYSAMK

SEQ ID NO: 13517 - protein, 10 aa, Artificial Sequence
  Description of Artificial Sequence: Synthetic peptide
  Seed: AGLEEYSAMR (NRAS Q61L)
AYLEEYSAMR

SEQ ID NO: 13518 - protein, 9 aa, Artificial Sequence
  Description of Artificial Sequence: Synthetic peptide
  Seed: AGLEEYSAM (NRAS Q61L)
AYLEEYSAY

SEQ ID NO: 13519 - protein, 10 aa, Artificial Sequence
  Description of Artificial Sequence: Synthetic peptide
  Seed: DTAGLEEYSA (NRAS Q61L)
DAAGLEEYSI

SEQ ID NO: 13520 - protein, 10 aa, Artificial Sequence
  Description of Artificial Sequence: Synthetic peptide
  Seed: DTAGLEEYSA (NRAS Q61L)
DAAGLEEYSV

SEQ ID NO: 13521 - protein, 11 aa, Artificial Sequence
  Description of Artificial Sequence: Synthetic peptide
  Seed: DTAGLEEYSAM (NRAS Q61L)
DIAGLEEYSAY

SEQ ID NO: 13522 - protein, 10 aa, Artificial Sequence
  Description of Artificial Sequence: Synthetic peptide
  Seed: DTAGLEEYSA (NRAS Q61L)
DIAGLEEYSI

SEQ ID NO: 13523 - protein, 10 aa, Artificial Sequence
  Description of Artificial Sequence: Synthetic peptide
  Seed: DTAGLEEYSA (NRAS Q61L)
DIAGLEEYSV

SEQ ID NO: 13524 - protein, 10 aa, Artificial Sequence
  Description of Artificial Sequence: Synthetic peptide
  Seed: DTAGLEEYSA (NRAS Q61L)
DSAGLEEYSI

SEQ ID NO: 13525 - protein, 10 aa, Artificial Sequence
  Description of Artificial Sequence: Synthetic peptide
  Seed: DTAGLEEYSA (NRAS Q61L)
DSAGLEEYSV

SEQ ID NO: 13526 - protein, 11 aa, Artificial Sequence
  Description of Artificial Sequence: Synthetic peptide
  Seed: DTAGLEEYSAM (NRAS Q61L)
DTAGLEEYSAF

SEQ ID NO: 13527 - protein, 11 aa, Artificial Sequence
  Description of Artificial Sequence: Synthetic peptide
  Seed: DTAGLEEYSAM (NRAS Q61L)
DTAGLEEYSAY

SEQ ID NO: 13528 - protein, 10 aa, Artificial Sequence
  Description of Artificial Sequence: Synthetic peptide
  Seed: DTAGLEEYSA (NRAS Q61L)
DTAGLEEYSI

SEQ ID NO: 13529 - protein, 10 aa, Artificial Sequence
  Description of Artificial Sequence: Synthetic peptide
  Seed: DTAGLEEYSA (NRAS Q61L)
DTAGLEEYSL

SEQ ID NO: 13530 - protein, 10 aa, Artificial Sequence
  Description of Artificial Sequence: Synthetic peptide
  Seed: DTAGLEEYSA (NRAS Q61L)
DTAGLEEYSM

SEQ ID NO: 13531 - protein, 11 aa, Artificial Sequence
  Description of Artificial Sequence: Synthetic peptide
  Seed: DTAGLEEYSAM (NRAS Q61L)
DVAGLEEYSAF

SEQ ID NO: 13532 - protein, 11 aa, Artificial Sequence
  Description of Artificial Sequence: Synthetic peptide
  Seed: DTAGLEEYSAM (NRAS Q61L)
DVAGLEEYSAY

SEQ ID NO: 13533 - protein, 10 aa, Artificial Sequence
  Description of Artificial Sequence: Synthetic peptide
  Seed: DTAGLEEYSA (NRAS Q61L)
DVAGLEEYSI

SEQ ID NO: 13534 - protein, 10 aa, Artificial Sequence
  Description of Artificial Sequence: Synthetic peptide
  Seed: DTAGLEEYSA (NRAS Q61L)
DVAGLEEYSL

SEQ ID NO: 13535 - protein, 10 aa, Artificial Sequence
  Description of Artificial Sequence: Synthetic peptide
  Seed: ILDTAGLEEY (NRAS Q61L)
IADTAGLEEY

SEQ ID NO: 13536 - protein, 10 aa, Artificial Sequence
  Description of Artificial Sequence: Synthetic peptide
  Seed: ILDTAGLEEY (NRAS Q61L)
IFDTAGLEEY

SEQ ID NO: 13537 - protein, 10 aa, Artificial Sequence
  Description of Artificial Sequence: Synthetic peptide
  Seed: ILDTAGLEEY (NRAS Q61L)
IGDTAGLEEY

SEQ ID NO: 13538 - protein, 10 aa, Artificial Sequence
  Description of Artificial Sequence: Synthetic peptide
  Seed: ILDTAGLEEY (NRAS Q61L)
IIDTAGLEEY

SEQ ID NO: 13539 - protein, 10 aa, Artificial Sequence
  Description of Artificial Sequence: Synthetic peptide
  Seed: ILDTAGLEEY (NRAS Q61L)
ILDTAGLEEF

SEQ ID NO: 13540 - protein, 10 aa, Artificial Sequence
  Description of Artificial Sequence: Synthetic peptide
  Seed: ILDTAGLEEY (NRAS Q61L)
IMDTAGLEEF

SEQ ID NO: 13541 - protein, 10 aa, Artificial Sequence
  Description of Artificial Sequence: Synthetic peptide
  Seed: ILDTAGLEEY (NRAS Q61L)
INDTAGLEEY

SEQ ID NO: 13542 - protein, 10 aa, Artificial Sequence
  Description of Artificial Sequence: Synthetic peptide
  Seed: ILDTAGLEEY (NRAS Q61L)
IQDTAGLEEF

SEQ ID NO: 13543 - protein, 10 aa, Artificial Sequence
  Description of Artificial Sequence: Synthetic peptide
  Seed: ILDTAGLEEY (NRAS Q61L)
IQDTAGLEEY

SEQ ID NO: 13544 - protein, 10 aa, Artificial Sequence
  Description of Artificial Sequence: Synthetic peptide
  Seed: ILDTAGLEEY (NRAS Q61L)
ITDTAGLEEF

SEQ ID NO: 13545 - protein, 10 aa, Artificial Sequence
  Description of Artificial Sequence: Synthetic peptide
  Seed: ILDTAGLEEY (NRAS Q61L)
ITDTAGLEEM

SEQ ID NO: 13546 - protein, 10 aa, Artificial Sequence
  Description of Artificial Sequence: Synthetic peptide
  Seed: ILDTAGLEEY (NRAS Q61L)
IWDTAGLEEY

SEQ ID NO: 13547 - protein, 10 aa, Artificial Sequence
  Description of Artificial Sequence: Synthetic peptide
  Seed: ILDTAGLEEY (NRAS Q61L)
IYDTAGLEEY

SEQ ID NO: 13548 - protein, 9 aa, Artificial Sequence
  Description of Artificial Sequence: Synthetic peptide
  Seed: AGLEEYSAM (NRAS Q61L)
AALEEYSAA

SEQ ID NO: 13549 - protein, 9 aa, Artificial Sequence
  Description of Artificial Sequence: Synthetic peptide
  Seed: AGLEEYSAM (NRAS Q61L)
AALEEYSAC

SEQ ID NO: 13550 - protein, 9 aa, Artificial Sequence
  Description of Artificial Sequence: Synthetic peptide
  Seed: AGLEEYSAM (NRAS Q61L)
AALEEYSAH

SEQ ID NO: 13551 - protein, 9 aa, Artificial Sequence
  Description of Artificial Sequence: Synthetic peptide
  Seed: AGLEEYSAM (NRAS Q61L)
AALEEYSAI

SEQ ID NO: 13552 - protein, 9 aa, Artificial Sequence
  Description of Artificial Sequence: Synthetic peptide
  Seed: AGLEEYSAM (NRAS Q61L)
AALEEYSAK

SEQ ID NO: 13553 - protein, 10 aa, Artificial Sequence
  Description of Artificial Sequence: Synthetic peptide
  Seed: AGLEEYSAMR (NRAS Q61L)
AALEEYSAMK

SEQ ID NO: 13554 - protein, 10 aa, Artificial Sequence
  Description of Artificial Sequence: Synthetic peptide
  Seed: AGLEEYSAMR (NRAS Q61L)
AALEEYSAML

SEQ ID NO: 13555 - protein, 9 aa, Artificial Sequence
  Description of Artificial Sequence: Synthetic peptide
  Seed: AGLEEYSAM (NRAS Q61L)
AALEEYSAQ

SEQ ID NO: 13556 - protein, 9 aa, Artificial Sequence
  Description of Artificial Sequence: Synthetic peptide
  Seed: AGLEEYSAM (NRAS Q61L)
AALEEYSAR

SEQ ID NO: 13557 - protein, 9 aa, Artificial Sequence
  Description of Artificial Sequence: Synthetic peptide
  Seed: AGLEEYSAM (NRAS Q61L)
AALEEYSAS

SEQ ID NO: 13558 - protein, 9 aa, Artificial Sequence
  Description of Artificial Sequence: Synthetic peptide
  Seed: AGLEEYSAM (NRAS Q61L)
AALEEYSAT

SEQ ID NO: 13559 - protein, 9 aa, Artificial Sequence
  Description of Artificial Sequence: Synthetic peptide
  Seed: AGLEEYSAM (NRAS Q61L)
AALEEYSAV

SEQ ID NO: 13560 - protein, 9 aa, Artificial Sequence
  Description of Artificial Sequence: Synthetic peptide
  Seed: AGLEEYSAM (NRAS Q61L)
AALEEYSAW

SEQ ID NO: 13561 - protein, 9 aa, Artificial Sequence
  Description of Artificial Sequence: Synthetic peptide
  Seed: AGLEEYSAM (NRAS Q61L)
ACLEEYSAK

SEQ ID NO: 13562 - protein, 9 aa, Artificial Sequence
  Description of Artificial Sequence: Synthetic peptide
  Seed: AGLEEYSAM (NRAS Q61L)
ACLEEYSAL

SEQ ID NO: 13563 - protein, 9 aa, Artificial Sequence
  Description of Artificial Sequence: Synthetic peptide
  Seed: AGLEEYSAM (NRAS Q61L)
ACLEEYSAM

SEQ ID NO: 13564 - protein, 9 aa, Artificial Sequence
  Description of Artificial Sequence: Synthetic peptide
  Seed: AGLEEYSAM (NRAS Q61L)
ADLEEYSAF

SEQ ID NO: 13565 - protein, 9 aa, Artificial Sequence
  Description of Artificial Sequence: Synthetic peptide
  Seed: AGLEEYSAM (NRAS Q61L)
ADLEEYSAK

SEQ ID NO: 13566 - protein, 9 aa, Artificial Sequence
  Description of Artificial Sequence: Synthetic peptide
  Seed: AGLEEYSAM (NRAS Q61L)
ADLEEYSAL

SEQ ID NO: 13567 - protein, 9 aa, Artificial Sequence
  Description of Artificial Sequence: Synthetic peptide
  Seed: AGLEEYSAM (NRAS Q61L)
ADLEEYSAM

SEQ ID NO: 13568 - protein, 9 aa, Artificial Sequence
  Description of Artificial Sequence: Synthetic peptide
  Seed: AGLEEYSAM (NRAS Q61L)
ADLEEYSAR

SEQ ID NO: 13569 - protein, 9 aa, Artificial Sequence
  Description of Artificial Sequence: Synthetic peptide
  Seed: AGLEEYSAM (NRAS Q61L)
ADLEEYSAY

SEQ ID NO: 13570 - protein, 9 aa, Artificial Sequence
  Description of Artificial Sequence: Synthetic peptide
  Seed: AGLEEYSAM (NRAS Q61L)
AELEEYSAI

SEQ ID NO: 13571 - protein, 9 aa, Artificial Sequence
  Description of Artificial Sequence: Synthetic peptide
  Seed: AGLEEYSAM (NRAS Q61L)
AELEEYSAK

SEQ ID NO: 13572 - protein, 9 aa, Artificial Sequence
  Description of Artificial Sequence: Synthetic peptide
  Seed: AGLEEYSAM (NRAS Q61L)
AELEEYSAL

SEQ ID NO: 13573 - protein, 9 aa, Artificial Sequence
  Description of Artificial Sequence: Synthetic peptide
  Seed: AGLEEYSAM (NRAS Q61L)
AELEEYSAR

SEQ ID NO: 13574 - protein, 9 aa, Artificial Sequence
  Description of Artificial Sequence: Synthetic peptide
  Seed: AGLEEYSAM (NRAS Q61L)
AELEEYSAV

SEQ ID NO: 13575 - protein, 9 aa, Artificial Sequence
  Description of Artificial Sequence: Synthetic peptide
  Seed: AGLEEYSAM (NRAS Q61L)
AELEEYSAW

SEQ ID NO: 13576 - protein, 9 aa, Artificial Sequence
  Description of Artificial Sequence: Synthetic peptide
  Seed: AGLEEYSAM (NRAS Q61L)
AFLEEYSAI

SEQ ID NO: 13577 - protein, 9 aa, Artificial Sequence
  Description of Artificial Sequence: Synthetic peptide
  Seed: AGLEEYSAM (NRAS Q61L)
AFLEEYSAL

SEQ ID NO: 13578 - protein, 9 aa, Artificial Sequence
  Description of Artificial Sequence: Synthetic peptide
  Seed: AGLEEYSAM (NRAS Q61L)
AFLEEYSAM

SEQ ID NO: 13579 - protein, 9 aa, Artificial Sequence
  Description of Artificial Sequence: Synthetic peptide
  Seed: AGLEEYSAM (NRAS Q61L)
AGLEEYSAH

SEQ ID NO: 13580 - protein, 9 aa, Artificial Sequence
  Description of Artificial Sequence: Synthetic peptide
  Seed: AGLEEYSAM (NRAS Q61L)
AGLEEYSAI

SEQ ID NO: 13581 - protein, 9 aa, Artificial Sequence
  Description of Artificial Sequence: Synthetic peptide
  Seed: AGLEEYSAM (NRAS Q61L)
AGLEEYSAK

SEQ ID NO: 13582 - protein, 9 aa, Artificial Sequence
  Description of Artificial Sequence: Synthetic peptide
  Seed: AGLEEYSAM (NRAS Q61L)
AGLEEYSAL

SEQ ID NO: 13583 - protein, 10 aa, Artificial Sequence
  Description of Artificial Sequence: Synthetic peptide
  Seed: AGLEEYSAMR (NRAS Q61L)
AGLEEYSAMK

SEQ ID NO: 13584 - protein, 9 aa, Artificial Sequence
  Description of Artificial Sequence: Synthetic peptide
  Seed: AGLEEYSAM (NRAS Q61L)
AGLEEYSAR

SEQ ID NO: 13585 - protein, 9 aa, Artificial Sequence
  Description of Artificial Sequence: Synthetic peptide
  Seed: AGLEEYSAM (NRAS Q61L)
AGLEEYSAV

SEQ ID NO: 13586 - protein, 9 aa, Artificial Sequence
  Description of Artificial Sequence: Synthetic peptide
  Seed: AGLEEYSAM (NRAS Q61L)
AHLEEYSAI

SEQ ID NO: 13587 - protein, 9 aa, Artificial Sequence
  Description of Artificial Sequence: Synthetic peptide
  Seed: AGLEEYSAM (NRAS Q61L)
AHLEEYSAV

SEQ ID NO: 13588 - protein, 9 aa, Artificial Sequence
  Description of Artificial Sequence: Synthetic peptide
  Seed: AGLEEYSAM (NRAS Q61L)
AILEEYSAH

SEQ ID NO: 13589 - protein, 9 aa, Artificial Sequence
  Description of Artificial Sequence: Synthetic peptide
  Seed: AGLEEYSAM (NRAS Q61L)
AILEEYSAI

SEQ ID NO: 13590 - protein, 9 aa, Artificial Sequence
  Description of Artificial Sequence: Synthetic peptide
  Seed: AGLEEYSAM (NRAS Q61L)
AILEEYSAK

SEQ ID NO: 13591 - protein, 9 aa, Artificial Sequence
  Description of Artificial Sequence: Synthetic peptide
  Seed: AGLEEYSAM (NRAS Q61L)
AILEEYSAL

SEQ ID NO: 13592 - protein, 10 aa, Artificial Sequence
  Description of Artificial Sequence: Synthetic peptide
  Seed: AGLEEYSAMR (NRAS Q61L)
AILEEYSAMK

SEQ ID NO: 13593 - protein, 9 aa, Artificial Sequence
  Description of Artificial Sequence: Synthetic peptide
  Seed: AGLEEYSAM (NRAS Q61L)
AILEEYSAR

SEQ ID NO: 13594 - protein, 9 aa, Artificial Sequence
  Description of Artificial Sequence: Synthetic peptide
  Seed: AGLEEYSAM (NRAS Q61L)
AILEEYSAV

SEQ ID NO: 13595 - protein, 9 aa, Artificial Sequence
  Description of Artificial Sequence: Synthetic peptide
  Seed: AGLEEYSAM (NRAS Q61L)
AILEEYSAW

SEQ ID NO: 13596 - protein, 9 aa, Artificial Sequence
  Description of Artificial Sequence: Synthetic peptide
  Seed: AGLEEYSAM (NRAS Q61L)
ALLEEYSAH

SEQ ID NO: 13597 - protein, 9 aa, Artificial Sequence
  Description of Artificial Sequence: Synthetic peptide
  Seed: AGLEEYSAM (NRAS Q61L)
ALLEEYSAI

SEQ ID NO: 13598 - protein, 9 aa, Artificial Sequence
  Description of Artificial Sequence: Synthetic peptide
  Seed: AGLEEYSAM (NRAS Q61L)
ALLEEYSAK

SEQ ID NO: 13599 - protein, 10 aa, Artificial Sequence
  Description of Artificial Sequence: Synthetic peptide
  Seed: AGLEEYSAMR (NRAS Q61L)
ALLEEYSAMK

SEQ ID NO: 13600 - protein, 9 aa, Artificial Sequence
  Description of Artificial Sequence: Synthetic peptide
  Seed: AGLEEYSAM (NRAS Q61L)
ALLEEYSAR

SEQ ID NO: 13601 - protein, 9 aa, Artificial Sequence
  Description of Artificial Sequence: Synthetic peptide
  Seed: AGLEEYSAM (NRAS Q61L)
ALLEEYSAV

SEQ ID NO: 13602 - protein, 9 aa, Artificial Sequence
  Description of Artificial Sequence: Synthetic peptide
  Seed: AGLEEYSAM (NRAS Q61L)
ALLEEYSAW

SEQ ID NO: 13603 - protein, 9 aa, Artificial Sequence
  Description of Artificial Sequence: Synthetic peptide
  Seed: AGLEEYSAM (NRAS Q61L)
ANLEEYSAH

SEQ ID NO: 13604 - protein, 9 aa, Artificial Sequence
  Description of Artificial Sequence: Synthetic peptide
  Seed: AGLEEYSAM (NRAS Q61L)
ANLEEYSAI

SEQ ID NO: 13605 - protein, 9 aa, Artificial Sequence
  Description of Artificial Sequence: Synthetic peptide
  Seed: AGLEEYSAM (NRAS Q61L)
ANLEEYSAK

SEQ ID NO: 13606 - protein, 9 aa, Artificial Sequence
  Description of Artificial Sequence: Synthetic peptide
  Seed: AGLEEYSAM (NRAS Q61L)
ANLEEYSAL

SEQ ID NO: 13607 - protein, 10 aa, Artificial Sequence
  Description of Artificial Sequence: Synthetic peptide
  Seed: AGLEEYSAMR (NRAS Q61L)
ANLEEYSAMR

SEQ ID NO: 13608 - protein, 9 aa, Artificial Sequence
  Description of Artificial Sequence: Synthetic peptide
  Seed: AGLEEYSAM (NRAS Q61L)
ANLEEYSAR

SEQ ID NO: 13609 - protein, 9 aa, Artificial Sequence
  Description of Artificial Sequence: Synthetic peptide
  Seed: AGLEEYSAM (NRAS Q61L)
ANLEEYSAV

SEQ ID NO: 13610 - protein, 9 aa, Artificial Sequence
  Description of Artificial Sequence: Synthetic peptide
  Seed: AGLEEYSAM (NRAS Q61L)
APLEEYSAF

SEQ ID NO: 13611 - protein, 9 aa, Artificial Sequence
  Description of Artificial Sequence: Synthetic peptide
  Seed: AGLEEYSAM (NRAS Q61L)
APLEEYSAL

SEQ ID NO: 13612 - protein, 9 aa, Artificial Sequence
  Description of Artificial Sequence: Synthetic peptide
  Seed: AGLEEYSAM (NRAS Q61L)
APLEEYSAM

SEQ ID NO: 13613 - protein, 9 aa, Artificial Sequence
  Description of Artificial Sequence: Synthetic peptide
  Seed: AGLEEYSAM (NRAS Q61L)
APLEEYSAW

SEQ ID NO: 13614 - protein, 9 aa, Artificial Sequence
  Description of Artificial Sequence: Synthetic peptide
  Seed: AGLEEYSAM (NRAS Q61L)
APLEEYSAY

SEQ ID NO: 13615 - protein, 9 aa, Artificial Sequence
  Description of Artificial Sequence: Synthetic peptide
  Seed: AGLEEYSAM (NRAS Q61L)
AQLEEYSAC

SEQ ID NO: 13616 - protein, 9 aa, Artificial Sequence
  Description of Artificial Sequence: Synthetic peptide
  Seed: AGLEEYSAM (NRAS Q61L)
AQLEEYSAK

SEQ ID NO: 13617 - protein, 10 aa, Artificial Sequence
  Description of Artificial Sequence: Synthetic peptide
  Seed: AGLEEYSAMR (NRAS Q61L)
AQLEEYSAMK

SEQ ID NO: 13618 - protein, 9 aa, Artificial Sequence
  Description of Artificial Sequence: Synthetic peptide
  Seed: AGLEEYSAM (NRAS Q61L)
AQLEEYSAR

SEQ ID NO: 13619 - protein, 9 aa, Artificial Sequence
  Description of Artificial Sequence: Synthetic peptide
  Seed: AGLEEYSAM (NRAS Q61L)
ARLEEYSAA

SEQ ID NO: 13620 - protein, 9 aa, Artificial Sequence
  Description of Artificial Sequence: Synthetic peptide
  Seed: AGLEEYSAM (NRAS Q61L)
ARLEEYSAC

SEQ ID NO: 13621 - protein, 9 aa, Artificial Sequence
  Description of Artificial Sequence: Synthetic peptide
  Seed: AGLEEYSAM (NRAS Q61L)
ARLEEYSAH

SEQ ID NO: 13622 - protein, 9 aa, Artificial Sequence
  Description of Artificial Sequence: Synthetic peptide
  Seed: AGLEEYSAM (NRAS Q61L)
ARLEEYSAI

SEQ ID NO: 13623 - protein, 9 aa, Artificial Sequence
  Description of Artificial Sequence: Synthetic peptide
  Seed: AGLEEYSAM (NRAS Q61L)
ARLEEYSAK

SEQ ID NO: 13624 - protein, 9 aa, Artificial Sequence
  Description of Artificial Sequence: Synthetic peptide
  Seed: AGLEEYSAM (NRAS Q61L)
ARLEEYSAR

SEQ ID NO: 13625 - protein, 9 aa, Artificial Sequence
  Description of Artificial Sequence: Synthetic peptide
  Seed: AGLEEYSAM (NRAS Q61L)
ARLEEYSAV

SEQ ID NO: 13626 - protein, 9 aa, Artificial Sequence
  Description of Artificial Sequence: Synthetic peptide
  Seed: AGLEEYSAM (NRAS Q61L)
ARLEEYSAW

SEQ ID NO: 13627 - protein, 9 aa, Artificial Sequence
  Description of Artificial Sequence: Synthetic peptide
  Seed: AGLEEYSAM (NRAS Q61L)
ASLEEYSAA

SEQ ID NO: 13628 - protein, 9 aa, Artificial Sequence
  Description of Artificial Sequence: Synthetic peptide
  Seed: AGLEEYSAM (NRAS Q61L)
ASLEEYSAH

SEQ ID NO: 13629 - protein, 9 aa, Artificial Sequence
  Description of Artificial Sequence: Synthetic peptide
  Seed: AGLEEYSAM (NRAS Q61L)
ASLEEYSAI

SEQ ID NO: 13630 - protein, 9 aa, Artificial Sequence
  Description of Artificial Sequence: Synthetic peptide
  Seed: AGLEEYSAM (NRAS Q61L)
ASLEEYSAK

SEQ ID NO: 13631 - protein, 10 aa, Artificial Sequence
  Description of Artificial Sequence: Synthetic peptide
  Seed: AGLEEYSAMR (NRAS Q61L)
ASLEEYSAMK

SEQ ID NO: 13632 - protein, 9 aa, Artificial Sequence
  Description of Artificial Sequence: Synthetic peptide
  Seed: AGLEEYSAM (NRAS Q61L)
ASLEEYSAR

SEQ ID NO: 13633 - protein, 9 aa, Artificial Sequence
  Description of Artificial Sequence: Synthetic peptide
  Seed: AGLEEYSAM (NRAS Q61L)
ASLEEYSAV

SEQ ID NO: 13634 - protein, 9 aa, Artificial Sequence
  Description of Artificial Sequence: Synthetic peptide
  Seed: AGLEEYSAM (NRAS Q61L)
ASLEEYSAW

SEQ ID NO: 13635 - protein, 9 aa, Artificial Sequence
  Description of Artificial Sequence: Synthetic peptide
  Seed: AGLEEYSAM (NRAS Q61L)
ATLEEYSAH

SEQ ID NO: 13636 - protein, 9 aa, Artificial Sequence
  Description of Artificial Sequence: Synthetic peptide
  Seed: AGLEEYSAM (NRAS Q61L)
ATLEEYSAI

SEQ ID NO: 13637 - protein, 9 aa, Artificial Sequence
  Description of Artificial Sequence: Synthetic peptide
  Seed: AGLEEYSAM (NRAS Q61L)
ATLEEYSAK

SEQ ID NO: 13638 - protein, 9 aa, Artificial Sequence
  Description of Artificial Sequence: Synthetic peptide
  Seed: AGLEEYSAM (NRAS Q61L)
ATLEEYSAL

SEQ ID NO: 13639 - protein, 10 aa, Artificial Sequence
  Description of Artificial Sequence: Synthetic peptide
  Seed: AGLEEYSAMR (NRAS Q61L)
ATLEEYSAMK

SEQ ID NO: 13640 - protein, 9 aa, Artificial Sequence
  Description of Artificial Sequence: Synthetic peptide
  Seed: AGLEEYSAM (NRAS Q61L)
ATLEEYSAR

SEQ ID NO: 13641 - protein, 9 aa, Artificial Sequence
  Description of Artificial Sequence: Synthetic peptide
  Seed: AGLEEYSAM (NRAS Q61L)
ATLEEYSAV

SEQ ID NO: 13642 - protein, 9 aa, Artificial Sequence
  Description of Artificial Sequence: Synthetic peptide
  Seed: AGLEEYSAM (NRAS Q61L)
ATLEEYSAW

SEQ ID NO: 13643 - protein, 9 aa, Artificial Sequence
  Description of Artificial Sequence: Synthetic peptide
  Seed: AGLEEYSAM (NRAS Q61L)
AVLEEYSAA

SEQ ID NO: 13644 - protein, 9 aa, Artificial Sequence
  Description of Artificial Sequence: Synthetic peptide
  Seed: AGLEEYSAM (NRAS Q61L)
AVLEEYSAH

SEQ ID NO: 13645 - protein, 9 aa, Artificial Sequence
  Description of Artificial Sequence: Synthetic peptide
  Seed: AGLEEYSAM (NRAS Q61L)
AVLEEYSAI

SEQ ID NO: 13646 - protein, 9 aa, Artificial Sequence
  Description of Artificial Sequence: Synthetic peptide
  Seed: AGLEEYSAM (NRAS Q61L)
AVLEEYSAK

SEQ ID NO: 13647 - protein, 9 aa, Artificial Sequence
  Description of Artificial Sequence: Synthetic peptide
  Seed: AGLEEYSAM (NRAS Q61L)
AVLEEYSAL

SEQ ID NO: 13648 - protein, 10 aa, Artificial Sequence
  Description of Artificial Sequence: Synthetic peptide
  Seed: AGLEEYSAMR (NRAS Q61L)
AVLEEYSAMK

SEQ ID NO: 13649 - protein, 9 aa, Artificial Sequence
  Description of Artificial Sequence: Synthetic peptide
  Seed: AGLEEYSAM (NRAS Q61L)
AVLEEYSAR

SEQ ID NO: 13650 - protein, 9 aa, Artificial Sequence
  Description of Artificial Sequence: Synthetic peptide
  Seed: AGLEEYSAM (NRAS Q61L)
AVLEEYSAV

SEQ ID NO: 13651 - protein, 9 aa, Artificial Sequence
  Description of Artificial Sequence: Synthetic peptide
  Seed: AGLEEYSAM (NRAS Q61L)
AVLEEYSAW

SEQ ID NO: 13652 - protein, 9 aa, Artificial Sequence
  Description of Artificial Sequence: Synthetic peptide
  Seed: AGLEEYSAM (NRAS Q61L)
AWLEEYSAL

SEQ ID NO: 13653 - protein, 9 aa, Artificial Sequence
  Description of Artificial Sequence: Synthetic peptide
  Seed: AGLEEYSAM (NRAS Q61L)
AWLEEYSAM

SEQ ID NO: 13654 - protein, 9 aa, Artificial Sequence
  Description of Artificial Sequence: Synthetic peptide
  Seed: AGLEEYSAM (NRAS Q61L)
AWLEEYSAY

SEQ ID NO: 13655 - protein, 9 aa, Artificial Sequence
  Description of Artificial Sequence: Synthetic peptide
  Seed: AGLEEYSAM (NRAS Q61L)
AYLEEYSAI

SEQ ID NO: 13656 - protein, 9 aa, Artificial Sequence
  Description of Artificial Sequence: Synthetic peptide
  Seed: AGLEEYSAM (NRAS Q61L)
AYLEEYSAL

SEQ ID NO: 13657 - protein, 9 aa, Artificial Sequence
  Description of Artificial Sequence: Synthetic peptide
  Seed: AGLEEYSAM (NRAS Q61L)
AYLEEYSAV

SEQ ID NO: 13658 - protein, 11 aa, Artificial Sequence
  Description of Artificial Sequence: Synthetic peptide
  Seed: DILDTAGLEEY (NRAS Q61L)
DALDTAGLEEF

SEQ ID NO: 13659 - protein, 11 aa, Artificial Sequence
  Description of Artificial Sequence: Synthetic peptide
  Seed: DILDTAGLEEY (NRAS Q61L)
DALDTAGLEEH

SEQ ID NO: 13660 - protein, 11 aa, Artificial Sequence
  Description of Artificial Sequence: Synthetic peptide
  Seed: DILDTAGLEEY (NRAS Q61L)
DALDTAGLEEK

SEQ ID NO: 13661 - protein, 11 aa, Artificial Sequence
  Description of Artificial Sequence: Synthetic peptide
  Seed: DILDTAGLEEY (NRAS Q61L)
DALDTAGLEEL

SEQ ID NO: 13662 - protein, 11 aa, Artificial Sequence
  Description of Artificial Sequence: Synthetic peptide
  Seed: DILDTAGLEEY (NRAS Q61L)
DALDTAGLEEM

SEQ ID NO: 13663 - protein, 11 aa, Artificial Sequence
  Description of Artificial Sequence: Synthetic peptide
  Seed: DILDTAGLEEY (NRAS Q61L)
DALDTAGLEER

SEQ ID NO: 13664 - protein, 11 aa, Artificial Sequence
  Description of Artificial Sequence: Synthetic peptide
  Seed: DILDTAGLEEY (NRAS Q61L)
DALDTAGLEEW

SEQ ID NO: 13665 - protein, 11 aa, Artificial Sequence
  Description of Artificial Sequence: Synthetic peptide
  Seed: DILDTAGLEEY (NRAS Q61L)
DALDTAGLEEY

SEQ ID NO: 13666 - protein, 11 aa, Artificial Sequence
  Description of Artificial Sequence: Synthetic peptide
  Seed: DILDTAGLEEY (NRAS Q61L)
DCLDTAGLEEK

SEQ ID NO: 13667 - protein, 11 aa, Artificial Sequence
  Description of Artificial Sequence: Synthetic peptide
  Seed: DILDTAGLEEY (NRAS Q61L)
DCLDTAGLEER

SEQ ID NO: 13668 - protein, 11 aa, Artificial Sequence
  Description of Artificial Sequence: Synthetic peptide
  Seed: DILDTAGLEEY (NRAS Q61L)
DCLDTAGLEEW

SEQ ID NO: 13669 - protein, 11 aa, Artificial Sequence
  Description of Artificial Sequence: Synthetic peptide
  Seed: DILDTAGLEEY (NRAS Q61L)
DDLDTAGLEEK

SEQ ID NO: 13670 - protein, 11 aa, Artificial Sequence
  Description of Artificial Sequence: Synthetic peptide
  Seed: DILDTAGLEEY (NRAS Q61L)
DDLDTAGLEER

SEQ ID NO: 13671 - protein, 11 aa, Artificial Sequence
  Description of Artificial Sequence: Synthetic peptide
  Seed: DILDTAGLEEY (NRAS Q61L)
DELDTAGLEEF

SEQ ID NO: 13672 - protein, 11 aa, Artificial Sequence
  Description of Artificial Sequence: Synthetic peptide
  Seed: DILDTAGLEEY (NRAS Q61L)
DELDTAGLEEK

SEQ ID NO: 13673 - protein, 11 aa, Artificial Sequence
  Description of Artificial Sequence: Synthetic peptide
  Seed: DILDTAGLEEY (NRAS Q61L)
DELDTAGLEER

SEQ ID NO: 13674 - protein, 11 aa, Artificial Sequence
  Description of Artificial Sequence: Synthetic peptide
  Seed: DILDTAGLEEY (NRAS Q61L)
DELDTAGLEEW

SEQ ID NO: 13675 - protein, 11 aa, Artificial Sequence
  Description of Artificial Sequence: Synthetic peptide
  Seed: DILDTAGLEEY (NRAS Q61L)
DELDTAGLEEY

SEQ ID NO: 13676 - protein, 11 aa, Artificial Sequence
  Description of Artificial Sequence: Synthetic peptide
  Seed: DILDTAGLEEY (NRAS Q61L)
DFLDTAGLEEK

SEQ ID NO: 13677 - protein, 11 aa, Artificial Sequence
  Description of Artificial Sequence: Synthetic peptide
  Seed: DILDTAGLEEY (NRAS Q61L)
DFLDTAGLEER

SEQ ID NO: 13678 - protein, 11 aa, Artificial Sequence
  Description of Artificial Sequence: Synthetic peptide
  Seed: DILDTAGLEEY (NRAS Q61L)
DFLDTAGLEEY

SEQ ID NO: 13679 - protein, 11 aa, Artificial Sequence
  Description of Artificial Sequence: Synthetic peptide
  Seed: DILDTAGLEEY (NRAS Q61L)
DGLDTAGLEEF

SEQ ID NO: 13680 - protein, 11 aa, Artificial Sequence
  Description of Artificial Sequence: Synthetic peptide
  Seed: DILDTAGLEEY (NRAS Q61L)
DGLDTAGLEEK

SEQ ID NO: 13681 - protein, 11 aa, Artificial Sequence
  Description of Artificial Sequence: Synthetic peptide
  Seed: DILDTAGLEEY (NRAS Q61L)
DGLDTAGLEER

SEQ ID NO: 13682 - protein, 11 aa, Artificial Sequence
  Description of Artificial Sequence: Synthetic peptide
  Seed: DILDTAGLEEY (NRAS Q61L)
DGLDTAGLEEW

SEQ ID NO: 13683 - protein, 11 aa, Artificial Sequence
  Description of Artificial Sequence: Synthetic peptide
  Seed: DILDTAGLEEY (NRAS Q61L)
DGLDTAGLEEY

SEQ ID NO: 13684 - protein, 11 aa, Artificial Sequence
  Description of Artificial Sequence: Synthetic peptide
  Seed: DILDTAGLEEY (NRAS Q61L)
DHLDTAGLEEY

SEQ ID NO: 13685 - protein, 10 aa, Artificial Sequence
  Description of Artificial Sequence: Synthetic peptide
  Seed: DTAGLEEYSA (NRAS Q61L)
DIAGLEEYSL

SEQ ID NO: 13686 - protein, 11 aa, Artificial Sequence
  Description of Artificial Sequence: Synthetic peptide
  Seed: DILDTAGLEEY (NRAS Q61L)
DILDTAGLEEF

SEQ ID NO: 13687 - protein, 11 aa, Artificial Sequence
  Description of Artificial Sequence: Synthetic peptide
  Seed: DILDTAGLEEY (NRAS Q61L)
DILDTAGLEEH

SEQ ID NO: 13688 - protein, 11 aa, Artificial Sequence
  Description of Artificial Sequence: Synthetic peptide
  Seed: DILDTAGLEEY (NRAS Q61L)
DILDTAGLEEK

SEQ ID NO: 13689 - protein, 11 aa, Artificial Sequence
  Description of Artificial Sequence: Synthetic peptide
  Seed: DILDTAGLEEY (NRAS Q61L)
DILDTAGLEEL

SEQ ID NO: 13690 - protein, 11 aa, Artificial Sequence
  Description of Artificial Sequence: Synthetic peptide
  Seed: DILDTAGLEEY (NRAS Q61L)
DILDTAGLEEM

SEQ ID NO: 13691 - protein, 11 aa, Artificial Sequence
  Description of Artificial Sequence: Synthetic peptide
  Seed: DILDTAGLEEY (NRAS Q61L)
DILDTAGLEEQ

SEQ ID NO: 13692 - protein, 11 aa, Artificial Sequence
  Description of Artificial Sequence: Synthetic peptide
  Seed: DILDTAGLEEY (NRAS Q61L)
DILDTAGLEER

SEQ ID NO: 13693 - protein, 11 aa, Artificial Sequence
  Description of Artificial Sequence: Synthetic peptide
  Seed: DILDTAGLEEY (NRAS Q61L)
DILDTAGLEEW

SEQ ID NO: 13694 - protein, 11 aa, Artificial Sequence
  Description of Artificial Sequence: Synthetic peptide
  Seed: DILDTAGLEEY (NRAS Q61L)
DKLDTAGLEEY

SEQ ID NO: 13695 - protein, 10 aa, Artificial Sequence
  Description of Artificial Sequence: Synthetic peptide
  Seed: DTAGLEEYSA (NRAS Q61L)
DLAGLEEYSV

SEQ ID NO: 13696 - protein, 11 aa, Artificial Sequence
  Description of Artificial Sequence: Synthetic peptide
  Seed: DILDTAGLEEY (NRAS Q61L)
DLLDTAGLEEF

SEQ ID NO: 13697 - protein, 11 aa, Artificial Sequence
  Description of Artificial Sequence: Synthetic peptide
  Seed: DILDTAGLEEY (NRAS Q61L)
DLLDTAGLEEK

SEQ ID NO: 13698 - protein, 11 aa, Artificial Sequence
  Description of Artificial Sequence: Synthetic peptide
  Seed: DILDTAGLEEY (NRAS Q61L)
DLLDTAGLEER

SEQ ID NO: 13699 - protein, 11 aa, Artificial Sequence
  Description of Artificial Sequence: Synthetic peptide
  Seed: DILDTAGLEEY (NRAS Q61L)
DLLDTAGLEEW

SEQ ID NO: 13700 - protein, 11 aa, Artificial Sequence
  Description of Artificial Sequence: Synthetic peptide
  Seed: DILDTAGLEEY (NRAS Q61L)
DLLDTAGLEEY

SEQ ID NO: 13701 - protein, 10 aa, Artificial Sequence
  Description of Artificial Sequence: Synthetic peptide
  Seed: DTAGLEEYSA (NRAS Q61L)
DMAGLEEYSV

SEQ ID NO: 13702 - protein, 11 aa, Artificial Sequence
  Description of Artificial Sequence: Synthetic peptide
  Seed: DILDTAGLEEY (NRAS Q61L)
DMLDTAGLEEF

SEQ ID NO: 13703 - protein, 11 aa, Artificial Sequence
  Description of Artificial Sequence: Synthetic peptide
  Seed: DILDTAGLEEY (NRAS Q61L)
DMLDTAGLEEK

SEQ ID NO: 13704 - protein, 11 aa, Artificial Sequence
  Description of Artificial Sequence: Synthetic peptide
  Seed: DILDTAGLEEY (NRAS Q61L)
DMLDTAGLEEM

SEQ ID NO: 13705 - protein, 11 aa, Artificial Sequence
  Description of Artificial Sequence: Synthetic peptide
  Seed: DILDTAGLEEY (NRAS Q61L)
DMLDTAGLEER

SEQ ID NO: 13706 - protein, 11 aa, Artificial Sequence
  Description of Artificial Sequence: Synthetic peptide
  Seed: DILDTAGLEEY (NRAS Q61L)
DMLDTAGLEEW

SEQ ID NO: 13707 - protein, 11 aa, Artificial Sequence
  Description of Artificial Sequence: Synthetic peptide
  Seed: DILDTAGLEEY (NRAS Q61L)
DMLDTAGLEEY

SEQ ID NO: 13708 - protein, 11 aa, Artificial Sequence
  Description of Artificial Sequence: Synthetic peptide
  Seed: DILDTAGLEEY (NRAS Q61L)
DNLDTAGLEEK

SEQ ID NO: 13709 - protein, 11 aa, Artificial Sequence
  Description of Artificial Sequence: Synthetic peptide
  Seed: DILDTAGLEEY (NRAS Q61L)
DNLDTAGLEER

SEQ ID NO: 13710 - protein, 11 aa, Artificial Sequence
  Description of Artificial Sequence: Synthetic peptide
  Seed: DILDTAGLEEY (NRAS Q61L)
DNLDTAGLEEY

SEQ ID NO: 13711 - protein, 11 aa, Artificial Sequence
  Description of Artificial Sequence: Synthetic peptide
  Seed: DILDTAGLEEY (NRAS Q61L)
DPLDTAGLEEF

SEQ ID NO: 13712 - protein, 11 aa, Artificial Sequence
  Description of Artificial Sequence: Synthetic peptide
  Seed: DILDTAGLEEY (NRAS Q61L)
DPLDTAGLEEK

SEQ ID NO: 13713 - protein, 11 aa, Artificial Sequence
  Description of Artificial Sequence: Synthetic peptide
  Seed: DILDTAGLEEY (NRAS Q61L)
DPLDTAGLEEL

SEQ ID NO: 13714 - protein, 11 aa, Artificial Sequence
  Description of Artificial Sequence: Synthetic peptide
  Seed: DILDTAGLEEY (NRAS Q61L)
DPLDTAGLEEM

SEQ ID NO: 13715 - protein, 11 aa, Artificial Sequence
  Description of Artificial Sequence: Synthetic peptide
  Seed: DILDTAGLEEY (NRAS Q61L)
DPLDTAGLEER

SEQ ID NO: 13716 - protein, 11 aa, Artificial Sequence
  Description of Artificial Sequence: Synthetic peptide
  Seed: DILDTAGLEEY (NRAS Q61L)
DPLDTAGLEEW

SEQ ID NO: 13717 - protein, 11 aa, Artificial Sequence
  Description of Artificial Sequence: Synthetic peptide
  Seed: DILDTAGLEEY (NRAS Q61L)
DPLDTAGLEEY

SEQ ID NO: 13718 - protein, 11 aa, Artificial Sequence
  Description of Artificial Sequence: Synthetic peptide
  Seed: DILDTAGLEEY (NRAS Q61L)
DQLDTAGLEEF

SEQ ID NO: 13719 - protein, 11 aa, Artificial Sequence
  Description of Artificial Sequence: Synthetic peptide
  Seed: DILDTAGLEEY (NRAS Q61L)
DQLDTAGLEEK

SEQ ID NO: 13720 - protein, 11 aa, Artificial Sequence
  Description of Artificial Sequence: Synthetic peptide
  Seed: DILDTAGLEEY (NRAS Q61L)
DQLDTAGLEEL

SEQ ID NO: 13721 - protein, 11 aa, Artificial Sequence
  Description of Artificial Sequence: Synthetic peptide
  Seed: DILDTAGLEEY (NRAS Q61L)
DQLDTAGLEEM

SEQ ID NO: 13722 - protein, 11 aa, Artificial Sequence
  Description of Artificial Sequence: Synthetic peptide
  Seed: DILDTAGLEEY (NRAS Q61L)
DQLDTAGLEER

SEQ ID NO: 13723 - protein, 11 aa, Artificial Sequence
  Description of Artificial Sequence: Synthetic peptide
  Seed: DILDTAGLEEY (NRAS Q61L)
DQLDTAGLEEW

SEQ ID NO: 13724 - protein, 11 aa, Artificial Sequence
  Description of Artificial Sequence: Synthetic peptide
  Seed: DILDTAGLEEY (NRAS Q61L)
DQLDTAGLEEY

SEQ ID NO: 13725 - protein, 11 aa, Artificial Sequence
  Description of Artificial Sequence: Synthetic peptide
  Seed: DILDTAGLEEY (NRAS Q61L)
DSLDTAGLEEF

SEQ ID NO: 13726 - protein, 11 aa, Artificial Sequence
  Description of Artificial Sequence: Synthetic peptide
  Seed: DILDTAGLEEY (NRAS Q61L)
DSLDTAGLEEK

SEQ ID NO: 13727 - protein, 11 aa, Artificial Sequence
  Description of Artificial Sequence: Synthetic peptide
  Seed: DILDTAGLEEY (NRAS Q61L)
DSLDTAGLEER

SEQ ID NO: 13728 - protein, 11 aa, Artificial Sequence
  Description of Artificial Sequence: Synthetic peptide
  Seed: DILDTAGLEEY (NRAS Q61L)
DSLDTAGLEEW

SEQ ID NO: 13729 - protein, 11 aa, Artificial Sequence
  Description of Artificial Sequence: Synthetic peptide
  Seed: DILDTAGLEEY (NRAS Q61L)
DSLDTAGLEEY

SEQ ID NO: 13730 - protein, 11 aa, Artificial Sequence
  Description of Artificial Sequence: Synthetic peptide
  Seed: DILDTAGLEEY (NRAS Q61L)
DTLDTAGLEEF

SEQ ID NO: 13731 - protein, 11 aa, Artificial Sequence
  Description of Artificial Sequence: Synthetic peptide
  Seed: DILDTAGLEEY (NRAS Q61L)
DTLDTAGLEEH

SEQ ID NO: 13732 - protein, 11 aa, Artificial Sequence
  Description of Artificial Sequence: Synthetic peptide
  Seed: DILDTAGLEEY (NRAS Q61L)
DTLDTAGLEEK

SEQ ID NO: 13733 - protein, 11 aa, Artificial Sequence
  Description of Artificial Sequence: Synthetic peptide
  Seed: DILDTAGLEEY (NRAS Q61L)
DTLDTAGLEEL

SEQ ID NO: 13734 - protein, 11 aa, Artificial Sequence
  Description of Artificial Sequence: Synthetic peptide
  Seed: DILDTAGLEEY (NRAS Q61L)
DTLDTAGLEEM

SEQ ID NO: 13735 - protein, 11 aa, Artificial Sequence
  Description of Artificial Sequence: Synthetic peptide
  Seed: DILDTAGLEEY (NRAS Q61L)
DTLDTAGLEEQ

SEQ ID NO: 13736 - protein, 11 aa, Artificial Sequence
  Description of Artificial Sequence: Synthetic peptide
  Seed: DILDTAGLEEY (NRAS Q61L)
DTLDTAGLEER

SEQ ID NO: 13737 - protein, 11 aa, Artificial Sequence
  Description of Artificial Sequence: Synthetic peptide
  Seed: DILDTAGLEEY (NRAS Q61L)
DTLDTAGLEEW

SEQ ID NO: 13738 - protein, 10 aa, Artificial Sequence
  Description of Artificial Sequence: Synthetic peptide
  Seed: DTAGLEEYSA (NRAS Q61L)
DVAGLEEYSA

SEQ ID NO: 13739 - protein, 11 aa, Artificial Sequence
  Description of Artificial Sequence: Synthetic peptide
  Seed: DILDTAGLEEY (NRAS Q61L)
DVLDTAGLEEF

SEQ ID NO: 13740 - protein, 11 aa, Artificial Sequence
  Description of Artificial Sequence: Synthetic peptide
  Seed: DILDTAGLEEY (NRAS Q61L)
DVLDTAGLEEH

SEQ ID NO: 13741 - protein, 11 aa, Artificial Sequence
  Description of Artificial Sequence: Synthetic peptide
  Seed: DILDTAGLEEY (NRAS Q61L)
DVLDTAGLEEL

SEQ ID NO: 13742 - protein, 11 aa, Artificial Sequence
  Description of Artificial Sequence: Synthetic peptide
  Seed: DILDTAGLEEY (NRAS Q61L)
DVLDTAGLEEM

SEQ ID NO: 13743 - protein, 11 aa, Artificial Sequence
  Description of Artificial Sequence: Synthetic peptide
  Seed: DILDTAGLEEY (NRAS Q61L)
DVLDTAGLEEQ

SEQ ID NO: 13744 - protein, 11 aa, Artificial Sequence
  Description of Artificial Sequence: Synthetic peptide
  Seed: DILDTAGLEEY (NRAS Q61L)
DVLDTAGLEEW

SEQ ID NO: 13745 - protein, 11 aa, Artificial Sequence
  Description of Artificial Sequence: Synthetic peptide
  Seed: DILDTAGLEEY (NRAS Q61L)
DWLDTAGLEER

SEQ ID NO: 13746 - protein, 11 aa, Artificial Sequence
  Description of Artificial Sequence: Synthetic peptide
  Seed: DILDTAGLEEY (NRAS Q61L)
DWLDTAGLEEY

SEQ ID NO: 13747 - protein, 11 aa, Artificial Sequence
  Description of Artificial Sequence: Synthetic peptide
  Seed: DILDTAGLEEY (NRAS Q61L)
DYLDTAGLEEK

SEQ ID NO: 13748 - protein, 11 aa, Artificial Sequence
  Description of Artificial Sequence: Synthetic peptide
  Seed: DILDTAGLEEY (NRAS Q61L)
DYLDTAGLEER

SEQ ID NO: 13749 - protein, 11 aa, Artificial Sequence
  Description of Artificial Sequence: Synthetic peptide
  Seed: DILDTAGLEEY (NRAS Q61L)
DYLDTAGLEEY

SEQ ID NO: 13750 - protein, 9 aa, Artificial Sequence
  Description of Artificial Sequence: Synthetic peptide
  Seed: ILDTAGLEE (NRAS Q61L)
IADTAGLEA

SEQ ID NO: 13751 - protein, 9 aa, Artificial Sequence
  Description of Artificial Sequence: Synthetic peptide
  Seed: ILDTAGLEE (NRAS Q61L)
IADTAGLEC

SEQ ID NO: 13752 - protein, 9 aa, Artificial Sequence
  Description of Artificial Sequence: Synthetic peptide
  Seed: ILDTAGLEE (NRAS Q61L)
IADTAGLED

SEQ ID NO: 13753 - protein, 9 aa, Artificial Sequence
  Description of Artificial Sequence: Synthetic peptide
  Seed: ILDTAGLEE (NRAS Q61L)
IADTAGLEE

SEQ ID NO: 13754 - protein, 10 aa, Artificial Sequence
  Description of Artificial Sequence: Synthetic peptide
  Seed: ILDTAGLEEY (NRAS Q61L)
IADTAGLEEA

SEQ ID NO: 13755 - protein, 10 aa, Artificial Sequence
  Description of Artificial Sequence: Synthetic peptide
  Seed: ILDTAGLEEY (NRAS Q61L)
IADTAGLEEC

SEQ ID NO: 13756 - protein, 10 aa, Artificial Sequence
  Description of Artificial Sequence: Synthetic peptide
  Seed: ILDTAGLEEY (NRAS Q61L)
IADTAGLEEF

SEQ ID NO: 13757 - protein, 10 aa, Artificial Sequence
  Description of Artificial Sequence: Synthetic peptide
  Seed: ILDTAGLEEY (NRAS Q61L)
IADTAGLEEH

SEQ ID NO: 13758 - protein, 10 aa, Artificial Sequence
  Description of Artificial Sequence: Synthetic peptide
  Seed: ILDTAGLEEY (NRAS Q61L)
IADTAGLEEI

SEQ ID NO: 13759 - protein, 10 aa, Artificial Sequence
  Description of Artificial Sequence: Synthetic peptide
  Seed: ILDTAGLEEY (NRAS Q61L)
IADTAGLEEK

SEQ ID NO: 13760 - protein, 10 aa, Artificial Sequence
  Description of Artificial Sequence: Synthetic peptide
  Seed: ILDTAGLEEY (NRAS Q61L)
IADTAGLEEL

SEQ ID NO: 13761 - protein, 10 aa, Artificial Sequence
  Description of Artificial Sequence: Synthetic peptide
  Seed: ILDTAGLEEY (NRAS Q61L)
IADTAGLEEM

SEQ ID NO: 13762 - protein, 10 aa, Artificial Sequence
  Description of Artificial Sequence: Synthetic peptide
  Seed: ILDTAGLEEY (NRAS Q61L)
IADTAGLEER

SEQ ID NO: 13763 - protein, 10 aa, Artificial Sequence
  Description of Artificial Sequence: Synthetic peptide
  Seed: ILDTAGLEEY (NRAS Q61L)
IADTAGLEES

SEQ ID NO: 13764 - protein, 10 aa, Artificial Sequence
  Description of Artificial Sequence: Synthetic peptide
  Seed: ILDTAGLEEY (NRAS Q61L)
IADTAGLEET

SEQ ID NO: 13765 - protein, 10 aa, Artificial Sequence
  Description of Artificial Sequence: Synthetic peptide
  Seed: ILDTAGLEEY (NRAS Q61L)
IADTAGLEEV

SEQ ID NO: 13766 - protein, 10 aa, Artificial Sequence
  Description of Artificial Sequence: Synthetic peptide
  Seed: ILDTAGLEEY (NRAS Q61L)
IADTAGLEEW

SEQ ID NO: 13767 - protein, 9 aa, Artificial Sequence
  Description of Artificial Sequence: Synthetic peptide
  Seed: ILDTAGLEE (NRAS Q61L)
IADTAGLEF

SEQ ID NO: 13768 - protein, 9 aa, Artificial Sequence
  Description of Artificial Sequence: Synthetic peptide
  Seed: ILDTAGLEE (NRAS Q61L)
IADTAGLEG

SEQ ID NO: 13769 - protein, 9 aa, Artificial Sequence
  Description of Artificial Sequence: Synthetic peptide
  Seed: ILDTAGLEE (NRAS Q61L)
IADTAGLEH

SEQ ID NO: 13770 - protein, 9 aa, Artificial Sequence
  Description of Artificial Sequence: Synthetic peptide
  Seed: ILDTAGLEE (NRAS Q61L)
IADTAGLEI

SEQ ID NO: 13771 - protein, 9 aa, Artificial Sequence
  Description of Artificial Sequence: Synthetic peptide
  Seed: ILDTAGLEE (NRAS Q61L)
IADTAGLEK

SEQ ID NO: 13772 - protein, 9 aa, Artificial Sequence
  Description of Artificial Sequence: Synthetic peptide
  Seed: ILDTAGLEE (NRAS Q61L)
IADTAGLEL

SEQ ID NO: 13773 - protein, 9 aa, Artificial Sequence
  Description of Artificial Sequence: Synthetic peptide
  Seed: ILDTAGLEE (NRAS Q61L)
IADTAGLEM

SEQ ID NO: 13774 - protein, 9 aa, Artificial Sequence
  Description of Artificial Sequence: Synthetic peptide
  Seed: ILDTAGLEE (NRAS Q61L)
IADTAGLEN

SEQ ID NO: 13775 - protein, 9 aa, Artificial Sequence
  Description of Artificial Sequence: Synthetic peptide
  Seed: ILDTAGLEE (NRAS Q61L)
IADTAGLEP

SEQ ID NO: 13776 - protein, 9 aa, Artificial Sequence
  Description of Artificial Sequence: Synthetic peptide
  Seed: ILDTAGLEE (NRAS Q61L)
IADTAGLEQ

SEQ ID NO: 13777 - protein, 9 aa, Artificial Sequence
  Description of Artificial Sequence: Synthetic peptide
  Seed: ILDTAGLEE (NRAS Q61L)
IADTAGLER

SEQ ID NO: 13778 - protein, 9 aa, Artificial Sequence
  Description of Artificial Sequence: Synthetic peptide
  Seed: ILDTAGLEE (NRAS Q61L)
IADTAGLES

SEQ ID NO: 13779 - protein, 9 aa, Artificial Sequence
  Description of Artificial Sequence: Synthetic peptide
  Seed: ILDTAGLEE (NRAS Q61L)
IADTAGLET

SEQ ID NO: 13780 - protein, 9 aa, Artificial Sequence
  Description of Artificial Sequence: Synthetic peptide
  Seed: ILDTAGLEE (NRAS Q61L)
IADTAGLEV

SEQ ID NO: 13781 - protein, 9 aa, Artificial Sequence
  Description of Artificial Sequence: Synthetic peptide
  Seed: ILDTAGLEE (NRAS Q61L)
IADTAGLEW

SEQ ID NO: 13782 - protein, 9 aa, Artificial Sequence
  Description of Artificial Sequence: Synthetic peptide
  Seed: ILDTAGLEE (NRAS Q61L)
IADTAGLEY

SEQ ID NO: 13783 - protein, 9 aa, Artificial Sequence
  Description of Artificial Sequence: Synthetic peptide
  Seed: ILDTAGLEE (NRAS Q61L)
ICDTAGLEA

SEQ ID NO: 13784 - protein, 9 aa, Artificial Sequence
  Description of Artificial Sequence: Synthetic peptide
  Seed: ILDTAGLEE (NRAS Q61L)
ICDTAGLEC

SEQ ID NO: 13785 - protein, 10 aa, Artificial Sequence
  Description of Artificial Sequence: Synthetic peptide
  Seed: ILDTAGLEEY (NRAS Q61L)
ICDTAGLEEF

SEQ ID NO: 13786 - protein, 10 aa, Artificial Sequence
  Description of Artificial Sequence: Synthetic peptide
  Seed: ILDTAGLEEY (NRAS Q61L)
ICDTAGLEEI

SEQ ID NO: 13787 - protein, 10 aa, Artificial Sequence
  Description of Artificial Sequence: Synthetic peptide
  Seed: ILDTAGLEEY (NRAS Q61L)
ICDTAGLEEK

SEQ ID NO: 13788 - protein, 10 aa, Artificial Sequence
  Description of Artificial Sequence: Synthetic peptide
  Seed: ILDTAGLEEY (NRAS Q61L)
ICDTAGLEEL

SEQ ID NO: 13789 - protein, 10 aa, Artificial Sequence
  Description of Artificial Sequence: Synthetic peptide
  Seed: ILDTAGLEEY (NRAS Q61L)
ICDTAGLEEM

SEQ ID NO: 13790 - protein, 10 aa, Artificial Sequence
  Description of Artificial Sequence: Synthetic peptide
  Seed: ILDTAGLEEY (NRAS Q61L)
ICDTAGLEER

SEQ ID NO: 13791 - protein, 10 aa, Artificial Sequence
  Description of Artificial Sequence: Synthetic peptide
  Seed: ILDTAGLEEY (NRAS Q61L)
ICDTAGLEEV

SEQ ID NO: 13792 - protein, 10 aa, Artificial Sequence
  Description of Artificial Sequence: Synthetic peptide
  Seed: ILDTAGLEEY (NRAS Q61L)
ICDTAGLEEY

SEQ ID NO: 13793 - protein, 9 aa, Artificial Sequence
  Description of Artificial Sequence: Synthetic peptide
  Seed: ILDTAGLEE (NRAS Q61L)
ICDTAGLEF

SEQ ID NO: 13794 - protein, 9 aa, Artificial Sequence
  Description of Artificial Sequence: Synthetic peptide
  Seed: ILDTAGLEE (NRAS Q61L)
ICDTAGLEI

SEQ ID NO: 13795 - protein, 9 aa, Artificial Sequence
  Description of Artificial Sequence: Synthetic peptide
  Seed: ILDTAGLEE (NRAS Q61L)
ICDTAGLEL

SEQ ID NO: 13796 - protein, 9 aa, Artificial Sequence
  Description of Artificial Sequence: Synthetic peptide
  Seed: ILDTAGLEE (NRAS Q61L)
ICDTAGLEM

SEQ ID NO: 13797 - protein, 9 aa, Artificial Sequence
  Description of Artificial Sequence: Synthetic peptide
  Seed: ILDTAGLEE (NRAS Q61L)
ICDTAGLET

SEQ ID NO: 13798 - protein, 9 aa, Artificial Sequence
  Description of Artificial Sequence: Synthetic peptide
  Seed: ILDTAGLEE (NRAS Q61L)
ICDTAGLEV

SEQ ID NO: 13799 - protein, 9 aa, Artificial Sequence
  Description of Artificial Sequence: Synthetic peptide
  Seed: ILDTAGLEE (NRAS Q61L)
ICDTAGLEW

SEQ ID NO: 13800 - protein, 9 aa, Artificial Sequence
  Description of Artificial Sequence: Synthetic peptide
  Seed: ILDTAGLEE (NRAS Q61L)
ICDTAGLEY

SEQ ID NO: 13801 - protein, 9 aa, Artificial Sequence
  Description of Artificial Sequence: Synthetic peptide
  Seed: ILDTAGLEE (NRAS Q61L)
IDDTAGLEA

SEQ ID NO: 13802 - protein, 9 aa, Artificial Sequence
  Description of Artificial Sequence: Synthetic peptide
  Seed: ILDTAGLEE (NRAS Q61L)
IDDTAGLEC

SEQ ID NO: 13803 - protein, 10 aa, Artificial Sequence
  Description of Artificial Sequence: Synthetic peptide
  Seed: ILDTAGLEEY (NRAS Q61L)
IDDTAGLEEF

SEQ ID NO: 13804 - protein, 10 aa, Artificial Sequence
  Description of Artificial Sequence: Synthetic peptide
  Seed: ILDTAGLEEY (NRAS Q61L)
IDDTAGLEEI

SEQ ID NO: 13805 - protein, 10 aa, Artificial Sequence
  Description of Artificial Sequence: Synthetic peptide
  Seed: ILDTAGLEEY (NRAS Q61L)
IDDTAGLEEK

SEQ ID NO: 13806 - protein, 10 aa, Artificial Sequence
  Description of Artificial Sequence: Synthetic peptide
  Seed: ILDTAGLEEY (NRAS Q61L)
IDDTAGLEEL

SEQ ID NO: 13807 - protein, 10 aa, Artificial Sequence
  Description of Artificial Sequence: Synthetic peptide
  Seed: ILDTAGLEEY (NRAS Q61L)
IDDTAGLEEM

SEQ ID NO: 13808 - protein, 10 aa, Artificial Sequence
  Description of Artificial Sequence: Synthetic peptide
  Seed: ILDTAGLEEY (NRAS Q61L)
IDDTAGLEER

SEQ ID NO: 13809 - protein, 10 aa, Artificial Sequence
  Description of Artificial Sequence: Synthetic peptide
  Seed: ILDTAGLEEY (NRAS Q61L)
IDDTAGLEEY

SEQ ID NO: 13810 - protein, 9 aa, Artificial Sequence
  Description of Artificial Sequence: Synthetic peptide
  Seed: ILDTAGLEE (NRAS Q61L)
IDDTAGLEF

SEQ ID NO: 13811 - protein, 9 aa, Artificial Sequence
  Description of Artificial Sequence: Synthetic peptide
  Seed: ILDTAGLEE (NRAS Q61L)
IDDTAGLEI

SEQ ID NO: 13812 - protein, 9 aa, Artificial Sequence
  Description of Artificial Sequence: Synthetic peptide
  Seed: ILDTAGLEE (NRAS Q61L)
IDDTAGLEL

SEQ ID NO: 13813 - protein, 9 aa, Artificial Sequence
  Description of Artificial Sequence: Synthetic peptide
  Seed: ILDTAGLEE (NRAS Q61L)
IDDTAGLEM

SEQ ID NO: 13814 - protein, 9 aa, Artificial Sequence
  Description of Artificial Sequence: Synthetic peptide
  Seed: ILDTAGLEE (NRAS Q61L)
IDDTAGLEV

SEQ ID NO: 13815 - protein, 9 aa, Artificial Sequence
  Description of Artificial Sequence: Synthetic peptide
  Seed: ILDTAGLEE (NRAS Q61L)
IDDTAGLEW

SEQ ID NO: 13816 - protein, 9 aa, Artificial Sequence
  Description of Artificial Sequence: Synthetic peptide
  Seed: ILDTAGLEE (NRAS Q61L)
IDDTAGLEY

SEQ ID NO: 13817 - protein, 9 aa, Artificial Sequence
  Description of Artificial Sequence: Synthetic peptide
  Seed: ILDTAGLEE (NRAS Q61L)
IEDTAGLEC

SEQ ID NO: 13818 - protein, 10 aa, Artificial Sequence
  Description of Artificial Sequence: Synthetic peptide
  Seed: ILDTAGLEEY (NRAS Q61L)
IEDTAGLEEF

SEQ ID NO: 13819 - protein, 10 aa, Artificial Sequence
  Description of Artificial Sequence: Synthetic peptide
  Seed: ILDTAGLEEY (NRAS Q61L)
IEDTAGLEEI

SEQ ID NO: 13820 - protein, 10 aa, Artificial Sequence
  Description of Artificial Sequence: Synthetic peptide
  Seed: ILDTAGLEEY (NRAS Q61L)
IEDTAGLEEK

SEQ ID NO: 13821 - protein, 10 aa, Artificial Sequence
  Description of Artificial Sequence: Synthetic peptide
  Seed: ILDTAGLEEY (NRAS Q61L)
IEDTAGLEEL

SEQ ID NO: 13822 - protein, 10 aa, Artificial Sequence
  Description of Artificial Sequence: Synthetic peptide
  Seed: ILDTAGLEEY (NRAS Q61L)
IEDTAGLEEM

SEQ ID NO: 13823 - protein, 10 aa, Artificial Sequence
  Description of Artificial Sequence: Synthetic peptide
  Seed: ILDTAGLEEY (NRAS Q61L)
IEDTAGLEER

SEQ ID NO: 13824 - protein, 10 aa, Artificial Sequence
  Description of Artificial Sequence: Synthetic peptide
  Seed: ILDTAGLEEY (NRAS Q61L)
IEDTAGLEEV

SEQ ID NO: 13825 - protein, 10 aa, Artificial Sequence
  Description of Artificial Sequence: Synthetic peptide
  Seed: ILDTAGLEEY (NRAS Q61L)
IEDTAGLEEW

SEQ ID NO: 13826 - protein, 10 aa, Artificial Sequence
  Description of Artificial Sequence: Synthetic peptide
  Seed: ILDTAGLEEY (NRAS Q61L)
IEDTAGLEEY

SEQ ID NO: 13827 - protein, 9 aa, Artificial Sequence
  Description of Artificial Sequence: Synthetic peptide
  Seed: ILDTAGLEE (NRAS Q61L)
IEDTAGLEF

SEQ ID NO: 13828 - protein, 9 aa, Artificial Sequence
  Description of Artificial Sequence: Synthetic peptide
  Seed: ILDTAGLEE (NRAS Q61L)
IEDTAGLEI

SEQ ID NO: 13829 - protein, 9 aa, Artificial Sequence
  Description of Artificial Sequence: Synthetic peptide
  Seed: ILDTAGLEE (NRAS Q61L)
IEDTAGLEL

SEQ ID NO: 13830 - protein, 9 aa, Artificial Sequence
  Description of Artificial Sequence: Synthetic peptide
  Seed: ILDTAGLEE (NRAS Q61L)
IEDTAGLEM

SEQ ID NO: 13831 - protein, 9 aa, Artificial Sequence
  Description of Artificial Sequence: Synthetic peptide
  Seed: ILDTAGLEE (NRAS Q61L)
IEDTAGLEV

SEQ ID NO: 13832 - protein, 9 aa, Artificial Sequence
  Description of Artificial Sequence: Synthetic peptide
  Seed: ILDTAGLEE (NRAS Q61L)
IEDTAGLEW

SEQ ID NO: 13833 - protein, 9 aa, Artificial Sequence
  Description of Artificial Sequence: Synthetic peptide
  Seed: ILDTAGLEE (NRAS Q61L)
IEDTAGLEY

SEQ ID NO: 13834 - protein, 9 aa, Artificial Sequence
  Description of Artificial Sequence: Synthetic peptide
  Seed: ILDTAGLEE (NRAS Q61L)
IFDTAGLEA

SEQ ID NO: 13835 - protein, 9 aa, Artificial Sequence
  Description of Artificial Sequence: Synthetic peptide
  Seed: ILDTAGLEE (NRAS Q61L)
IFDTAGLEC

SEQ ID NO: 13836 - protein, 10 aa, Artificial Sequence
  Description of Artificial Sequence: Synthetic peptide
  Seed: ILDTAGLEEY (NRAS Q61L)
IFDTAGLEEA

SEQ ID NO: 13837 - protein, 10 aa, Artificial Sequence
  Description of Artificial Sequence: Synthetic peptide
  Seed: ILDTAGLEEY (NRAS Q61L)
IFDTAGLEEC

SEQ ID NO: 13838 - protein, 10 aa, Artificial Sequence
  Description of Artificial Sequence: Synthetic peptide
  Seed: ILDTAGLEEY (NRAS Q61L)
IFDTAGLEEF

SEQ ID NO: 13839 - protein, 10 aa, Artificial Sequence
  Description of Artificial Sequence: Synthetic peptide
  Seed: ILDTAGLEEY (NRAS Q61L)
IFDTAGLEEI

SEQ ID NO: 13840 - protein, 10 aa, Artificial Sequence
  Description of Artificial Sequence: Synthetic peptide
  Seed: ILDTAGLEEY (NRAS Q61L)
IFDTAGLEEK

SEQ ID NO: 13841 - protein, 10 aa, Artificial Sequence
  Description of Artificial Sequence: Synthetic peptide
  Seed: ILDTAGLEEY (NRAS Q61L)
IFDTAGLEEL

SEQ ID NO: 13842 - protein, 10 aa, Artificial Sequence
  Description of Artificial Sequence: Synthetic peptide
  Seed: ILDTAGLEEY (NRAS Q61L)
IFDTAGLEEM

SEQ ID NO: 13843 - protein, 10 aa, Artificial Sequence
  Description of Artificial Sequence: Synthetic peptide
  Seed: ILDTAGLEEY (NRAS Q61L)
IFDTAGLEER

SEQ ID NO: 13844 - protein, 10 aa, Artificial Sequence
  Description of Artificial Sequence: Synthetic peptide
  Seed: ILDTAGLEEY (NRAS Q61L)
IFDTAGLEET

SEQ ID NO: 13845 - protein, 10 aa, Artificial Sequence
  Description of Artificial Sequence: Synthetic peptide
  Seed: ILDTAGLEEY (NRAS Q61L)
IFDTAGLEEV

SEQ ID NO: 13846 - protein, 10 aa, Artificial Sequence
  Description of Artificial Sequence: Synthetic peptide
  Seed: ILDTAGLEEY (NRAS Q61L)
IFDTAGLEEW

SEQ ID NO: 13847 - protein, 9 aa, Artificial Sequence
  Description of Artificial Sequence: Synthetic peptide
  Seed: ILDTAGLEE (NRAS Q61L)
IFDTAGLEF

SEQ ID NO: 13848 - protein, 9 aa, Artificial Sequence
  Description of Artificial Sequence: Synthetic peptide
  Seed: ILDTAGLEE (NRAS Q61L)
IFDTAGLEI

SEQ ID NO: 13849 - protein, 9 aa, Artificial Sequence
  Description of Artificial Sequence: Synthetic peptide
  Seed: ILDTAGLEE (NRAS Q61L)
IFDTAGLEL

SEQ ID NO: 13850 - protein, 9 aa, Artificial Sequence
  Description of Artificial Sequence: Synthetic peptide
  Seed: ILDTAGLEE (NRAS Q61L)
IFDTAGLEM

SEQ ID NO: 13851 - protein, 9 aa, Artificial Sequence
  Description of Artificial Sequence: Synthetic peptide
  Seed: ILDTAGLEE (NRAS Q61L)
IFDTAGLEP

SEQ ID NO: 13852 - protein, 9 aa, Artificial Sequence
  Description of Artificial Sequence: Synthetic peptide
  Seed: ILDTAGLEE (NRAS Q61L)
IFDTAGLEQ

SEQ ID NO: 13853 - protein, 9 aa, Artificial Sequence
  Description of Artificial Sequence: Synthetic peptide
  Seed: ILDTAGLEE (NRAS Q61L)
IFDTAGLES

SEQ ID NO: 13854 - protein, 9 aa, Artificial Sequence
  Description of Artificial Sequence: Synthetic peptide
  Seed: ILDTAGLEE (NRAS Q61L)
IFDTAGLET

SEQ ID NO: 13855 - protein, 9 aa, Artificial Sequence
  Description of Artificial Sequence: Synthetic peptide
  Seed: ILDTAGLEE (NRAS Q61L)
IFDTAGLEV

SEQ ID NO: 13856 - protein, 9 aa, Artificial Sequence
  Description of Artificial Sequence: Synthetic peptide
  Seed: ILDTAGLEE (NRAS Q61L)
IFDTAGLEW

SEQ ID NO: 13857 - protein, 9 aa, Artificial Sequence
  Description of Artificial Sequence: Synthetic peptide
  Seed: ILDTAGLEE (NRAS Q61L)
IFDTAGLEY

SEQ ID NO: 13858 - protein, 9 aa, Artificial Sequence
  Description of Artificial Sequence: Synthetic peptide
  Seed: ILDTAGLEE (NRAS Q61L)
IGDTAGLEA

SEQ ID NO: 13859 - protein, 9 aa, Artificial Sequence
  Description of Artificial Sequence: Synthetic peptide
  Seed: ILDTAGLEE (NRAS Q61L)
IGDTAGLEC

SEQ ID NO: 13860 - protein, 10 aa, Artificial Sequence
  Description of Artificial Sequence: Synthetic peptide
  Seed: ILDTAGLEEY (NRAS Q61L)
IGDTAGLEEA

SEQ ID NO: 13861 - protein, 10 aa, Artificial Sequence
  Description of Artificial Sequence: Synthetic peptide
  Seed: ILDTAGLEEY (NRAS Q61L)
IGDTAGLEEC

SEQ ID NO: 13862 - protein, 10 aa, Artificial Sequence
  Description of Artificial Sequence: Synthetic peptide
  Seed: ILDTAGLEEY (NRAS Q61L)
IGDTAGLEEF

SEQ ID NO: 13863 - protein, 10 aa, Artificial Sequence
  Description of Artificial Sequence: Synthetic peptide
  Seed: ILDTAGLEEY (NRAS Q61L)
IGDTAGLEEI

SEQ ID NO: 13864 - protein, 10 aa, Artificial Sequence
  Description of Artificial Sequence: Synthetic peptide
  Seed: ILDTAGLEEY (NRAS Q61L)
IGDTAGLEEK

SEQ ID NO: 13865 - protein, 10 aa, Artificial Sequence
  Description of Artificial Sequence: Synthetic peptide
  Seed: ILDTAGLEEY (NRAS Q61L)
IGDTAGLEEL

SEQ ID NO: 13866 - protein, 10 aa, Artificial Sequence
  Description of Artificial Sequence: Synthetic peptide
  Seed: ILDTAGLEEY (NRAS Q61L)
IGDTAGLEEM

SEQ ID NO: 13867 - protein, 10 aa, Artificial Sequence
  Description of Artificial Sequence: Synthetic peptide
  Seed: ILDTAGLEEY (NRAS Q61L)
IGDTAGLEER

SEQ ID NO: 13868 - protein, 10 aa, Artificial Sequence
  Description of Artificial Sequence: Synthetic peptide
  Seed: ILDTAGLEEY (NRAS Q61L)
IGDTAGLEEV

SEQ ID NO: 13869 - protein, 10 aa, Artificial Sequence
  Description of Artificial Sequence: Synthetic peptide
  Seed: ILDTAGLEEY (NRAS Q61L)
IGDTAGLEEW

SEQ ID NO: 13870 - protein, 9 aa, Artificial Sequence
  Description of Artificial Sequence: Synthetic peptide
  Seed: ILDTAGLEE (NRAS Q61L)
IGDTAGLEF

SEQ ID NO: 13871 - protein, 9 aa, Artificial Sequence
  Description of Artificial Sequence: Synthetic peptide
  Seed: ILDTAGLEE (NRAS Q61L)
IGDTAGLEI

SEQ ID NO: 13872 - protein, 9 aa, Artificial Sequence
  Description of Artificial Sequence: Synthetic peptide
  Seed: ILDTAGLEE (NRAS Q61L)
IGDTAGLEK

SEQ ID NO: 13873 - protein, 9 aa, Artificial Sequence
  Description of Artificial Sequence: Synthetic peptide
  Seed: ILDTAGLEE (NRAS Q61L)
IGDTAGLEL

SEQ ID NO: 13874 - protein, 9 aa, Artificial Sequence
  Description of Artificial Sequence: Synthetic peptide
  Seed: ILDTAGLEE (NRAS Q61L)
IGDTAGLEM

SEQ ID NO: 13875 - protein, 9 aa, Artificial Sequence
  Description of Artificial Sequence: Synthetic peptide
  Seed: ILDTAGLEE (NRAS Q61L)
IGDTAGLEP

SEQ ID NO: 13876 - protein, 9 aa, Artificial Sequence
  Description of Artificial Sequence: Synthetic peptide
  Seed: ILDTAGLEE (NRAS Q61L)
IGDTAGLER

SEQ ID NO: 13877 - protein, 9 aa, Artificial Sequence
  Description of Artificial Sequence: Synthetic peptide
  Seed: ILDTAGLEE (NRAS Q61L)
IGDTAGLES

SEQ ID NO: 13878 - protein, 9 aa, Artificial Sequence
  Description of Artificial Sequence: Synthetic peptide
  Seed: ILDTAGLEE (NRAS Q61L)
IGDTAGLET

SEQ ID NO: 13879 - protein, 9 aa, Artificial Sequence
  Description of Artificial Sequence: Synthetic peptide
  Seed: ILDTAGLEE (NRAS Q61L)
IGDTAGLEV

SEQ ID NO: 13880 - protein, 9 aa, Artificial Sequence
  Description of Artificial Sequence: Synthetic peptide
  Seed: ILDTAGLEE (NRAS Q61L)
IGDTAGLEW

SEQ ID NO: 13881 - protein, 9 aa, Artificial Sequence
  Description of Artificial Sequence: Synthetic peptide
  Seed: ILDTAGLEE (NRAS Q61L)
IGDTAGLEY

SEQ ID NO: 13882 - protein, 10 aa, Artificial Sequence
  Description of Artificial Sequence: Synthetic peptide
  Seed: ILDTAGLEEY (NRAS Q61L)
IHDTAGLEEF

SEQ ID NO: 13883 - protein, 10 aa, Artificial Sequence
  Description of Artificial Sequence: Synthetic peptide
  Seed: ILDTAGLEEY (NRAS Q61L)
IHDTAGLEEI

SEQ ID NO: 13884 - protein, 10 aa, Artificial Sequence
  Description of Artificial Sequence: Synthetic peptide
  Seed: ILDTAGLEEY (NRAS Q61L)
IHDTAGLEEK

SEQ ID NO: 13885 - protein, 10 aa, Artificial Sequence
  Description of Artificial Sequence: Synthetic peptide
  Seed: ILDTAGLEEY (NRAS Q61L)
IHDTAGLEEL

SEQ ID NO: 13886 - protein, 10 aa, Artificial Sequence
  Description of Artificial Sequence: Synthetic peptide
  Seed: ILDTAGLEEY (NRAS Q61L)
IHDTAGLEEM

SEQ ID NO: 13887 - protein, 10 aa, Artificial Sequence
  Description of Artificial Sequence: Synthetic peptide
  Seed: ILDTAGLEEY (NRAS Q61L)
IHDTAGLEEV

SEQ ID NO: 13888 - protein, 10 aa, Artificial Sequence
  Description of Artificial Sequence: Synthetic peptide
  Seed: ILDTAGLEEY (NRAS Q61L)
IHDTAGLEEY

SEQ ID NO: 13889 - protein, 9 aa, Artificial Sequence
  Description of Artificial Sequence: Synthetic peptide
  Seed: ILDTAGLEE (NRAS Q61L)
IHDTAGLEF

SEQ ID NO: 13890 - protein, 9 aa, Artificial Sequence
  Description of Artificial Sequence: Synthetic peptide
  Seed: ILDTAGLEE (NRAS Q61L)
IHDTAGLEI

SEQ ID NO: 13891 - protein, 9 aa, Artificial Sequence
  Description of Artificial Sequence: Synthetic peptide
  Seed: ILDTAGLEE (NRAS Q61L)
IHDTAGLEL

SEQ ID NO: 13892 - protein, 9 aa, Artificial Sequence
  Description of Artificial Sequence: Synthetic peptide
  Seed: ILDTAGLEE (NRAS Q61L)
IHDTAGLEM

SEQ ID NO: 13893 - protein, 9 aa, Artificial Sequence
  Description of Artificial Sequence: Synthetic peptide
  Seed: ILDTAGLEE (NRAS Q61L)
IHDTAGLEV

SEQ ID NO: 13894 - protein, 9 aa, Artificial Sequence
  Description of Artificial Sequence: Synthetic peptide
  Seed: ILDTAGLEE (NRAS Q61L)
IIDTAGLEA

SEQ ID NO: 13895 - protein, 9 aa, Artificial Sequence
  Description of Artificial Sequence: Synthetic peptide
  Seed: ILDTAGLEE (NRAS Q61L)
IIDTAGLEC

SEQ ID NO: 13896 - protein, 9 aa, Artificial Sequence
  Description of Artificial Sequence: Synthetic peptide
  Seed: ILDTAGLEE (NRAS Q61L)
IIDTAGLEE

SEQ ID NO: 13897 - protein, 10 aa, Artificial Sequence
  Description of Artificial Sequence: Synthetic peptide
  Seed: ILDTAGLEEY (NRAS Q61L)
IIDTAGLEEA

SEQ ID NO: 13898 - protein, 10 aa, Artificial Sequence
  Description of Artificial Sequence: Synthetic peptide
  Seed: ILDTAGLEEY (NRAS Q61L)
IIDTAGLEEC

SEQ ID NO: 13899 - protein, 10 aa, Artificial Sequence
  Description of Artificial Sequence: Synthetic peptide
  Seed: ILDTAGLEEY (NRAS Q61L)
IIDTAGLEEF

SEQ ID NO: 13900 - protein, 10 aa, Artificial Sequence
  Description of Artificial Sequence: Synthetic peptide
  Seed: ILDTAGLEEY (NRAS Q61L)
IIDTAGLEEH

SEQ ID NO: 13901 - protein, 10 aa, Artificial Sequence
  Description of Artificial Sequence: Synthetic peptide
  Seed: ILDTAGLEEY (NRAS Q61L)
IIDTAGLEEI

SEQ ID NO: 13902 - protein, 10 aa, Artificial Sequence
  Description of Artificial Sequence: Synthetic peptide
  Seed: ILDTAGLEEY (NRAS Q61L)
IIDTAGLEEK

SEQ ID NO: 13903 - protein, 10 aa, Artificial Sequence
  Description of Artificial Sequence: Synthetic peptide
  Seed: ILDTAGLEEY (NRAS Q61L)
IIDTAGLEEL

SEQ ID NO: 13904 - protein, 10 aa, Artificial Sequence
  Description of Artificial Sequence: Synthetic peptide
  Seed: ILDTAGLEEY (NRAS Q61L)
IIDTAGLEEM

SEQ ID NO: 13905 - protein, 10 aa, Artificial Sequence
  Description of Artificial Sequence: Synthetic peptide
  Seed: ILDTAGLEEY (NRAS Q61L)
IIDTAGLEEQ

SEQ ID NO: 13906 - protein, 10 aa, Artificial Sequence
  Description of Artificial Sequence: Synthetic peptide
  Seed: ILDTAGLEEY (NRAS Q61L)
IIDTAGLEER

SEQ ID NO: 13907 - protein, 10 aa, Artificial Sequence
  Description of Artificial Sequence: Synthetic peptide
  Seed: ILDTAGLEEY (NRAS Q61L)
IIDTAGLEET

SEQ ID NO: 13908 - protein, 10 aa, Artificial Sequence
  Description of Artificial Sequence: Synthetic peptide
  Seed: ILDTAGLEEY (NRAS Q61L)
IIDTAGLEEV

SEQ ID NO: 13909 - protein, 10 aa, Artificial Sequence
  Description of Artificial Sequence: Synthetic peptide
  Seed: ILDTAGLEEY (NRAS Q61L)
IIDTAGLEEW

SEQ ID NO: 13910 - protein, 9 aa, Artificial Sequence
  Description of Artificial Sequence: Synthetic peptide
  Seed: ILDTAGLEE (NRAS Q61L)
IIDTAGLEF

SEQ ID NO: 13911 - protein, 9 aa, Artificial Sequence
  Description of Artificial Sequence: Synthetic peptide
  Seed: ILDTAGLEE (NRAS Q61L)
IIDTAGLEG

SEQ ID NO: 13912 - protein, 9 aa, Artificial Sequence
  Description of Artificial Sequence: Synthetic peptide
  Seed: ILDTAGLEE (NRAS Q61L)
IIDTAGLEH

SEQ ID NO: 13913 - protein, 9 aa, Artificial Sequence
  Description of Artificial Sequence: Synthetic peptide
  Seed: ILDTAGLEE (NRAS Q61L)
IIDTAGLEI

SEQ ID NO: 13914 - protein, 9 aa, Artificial Sequence
  Description of Artificial Sequence: Synthetic peptide
  Seed: ILDTAGLEE (NRAS Q61L)
IIDTAGLEK

SEQ ID NO: 13915 - protein, 9 aa, Artificial Sequence
  Description of Artificial Sequence: Synthetic peptide
  Seed: ILDTAGLEE (NRAS Q61L)
IIDTAGLEL

SEQ ID NO: 13916 - protein, 9 aa, Artificial Sequence
  Description of Artificial Sequence: Synthetic peptide
  Seed: ILDTAGLEE (NRAS Q61L)
IIDTAGLEM

SEQ ID NO: 13917 - protein, 9 aa, Artificial Sequence
  Description of Artificial Sequence: Synthetic peptide
  Seed: ILDTAGLEE (NRAS Q61L)
IIDTAGLEN

SEQ ID NO: 13918 - protein, 9 aa, Artificial Sequence
  Description of Artificial Sequence: Synthetic peptide
  Seed: ILDTAGLEE (NRAS Q61L)
IIDTAGLEP

SEQ ID NO: 13919 - protein, 9 aa, Artificial Sequence
  Description of Artificial Sequence: Synthetic peptide
  Seed: ILDTAGLEE (NRAS Q61L)
IIDTAGLEQ

SEQ ID NO: 13920 - protein, 9 aa, Artificial Sequence
  Description of Artificial Sequence: Synthetic peptide
  Seed: ILDTAGLEE (NRAS Q61L)
IIDTAGLER

SEQ ID NO: 13921 - protein, 9 aa, Artificial Sequence
  Description of Artificial Sequence: Synthetic peptide
  Seed: ILDTAGLEE (NRAS Q61L)
IIDTAGLES

SEQ ID NO: 13922 - protein, 9 aa, Artificial Sequence
  Description of Artificial Sequence: Synthetic peptide
  Seed: ILDTAGLEE (NRAS Q61L)
IIDTAGLET

SEQ ID NO: 13923 - protein, 9 aa, Artificial Sequence
  Description of Artificial Sequence: Synthetic peptide
  Seed: ILDTAGLEE (NRAS Q61L)
IIDTAGLEV

SEQ ID NO: 13924 - protein, 9 aa, Artificial Sequence
  Description of Artificial Sequence: Synthetic peptide
  Seed: ILDTAGLEE (NRAS Q61L)
IIDTAGLEW

SEQ ID NO: 13925 - protein, 9 aa, Artificial Sequence
  Description of Artificial Sequence: Synthetic peptide
  Seed: ILDTAGLEE (NRAS Q61L)
IIDTAGLEY

SEQ ID NO: 13926 - protein, 10 aa, Artificial Sequence
  Description of Artificial Sequence: Synthetic peptide
  Seed: ILDTAGLEEY (NRAS Q61L)
IKDTAGLEEF

SEQ ID NO: 13927 - protein, 10 aa, Artificial Sequence
  Description of Artificial Sequence: Synthetic peptide
  Seed: ILDTAGLEEY (NRAS Q61L)
IKDTAGLEEK

SEQ ID NO: 13928 - protein, 10 aa, Artificial Sequence
  Description of Artificial Sequence: Synthetic peptide
  Seed: ILDTAGLEEY (NRAS Q61L)
IKDTAGLEEL

SEQ ID NO: 13929 - protein, 10 aa, Artificial Sequence
  Description of Artificial Sequence: Synthetic peptide
  Seed: ILDTAGLEEY (NRAS Q61L)
IKDTAGLEEM

SEQ ID NO: 13930 - protein, 10 aa, Artificial Sequence
  Description of Artificial Sequence: Synthetic peptide
  Seed: ILDTAGLEEY (NRAS Q61L)
IKDTAGLEEY

SEQ ID NO: 13931 - protein, 9 aa, Artificial Sequence
  Description of Artificial Sequence: Synthetic peptide
  Seed: ILDTAGLEE (NRAS Q61L)
IKDTAGLEF

SEQ ID NO: 13932 - protein, 9 aa, Artificial Sequence
  Description of Artificial Sequence: Synthetic peptide
  Seed: ILDTAGLEE (NRAS Q61L)
IKDTAGLEI

SEQ ID NO: 13933 - protein, 9 aa, Artificial Sequence
  Description of Artificial Sequence: Synthetic peptide
  Seed: ILDTAGLEE (NRAS Q61L)
IKDTAGLEL

SEQ ID NO: 13934 - protein, 9 aa, Artificial Sequence
  Description of Artificial Sequence: Synthetic peptide
  Seed: ILDTAGLEE (NRAS Q61L)
IKDTAGLEM

SEQ ID NO: 13935 - protein, 9 aa, Artificial Sequence
  Description of Artificial Sequence: Synthetic peptide
  Seed: ILDTAGLEE (NRAS Q61L)
IKDTAGLEV

SEQ ID NO: 13936 - protein, 9 aa, Artificial Sequence
  Description of Artificial Sequence: Synthetic peptide
  Seed: ILDTAGLEE (NRAS Q61L)
ILDTAGLEA

SEQ ID NO: 13937 - protein, 9 aa, Artificial Sequence
  Description of Artificial Sequence: Synthetic peptide
  Seed: ILDTAGLEE (NRAS Q61L)
ILDTAGLEC

SEQ ID NO: 13938 - protein, 10 aa, Artificial Sequence
  Description of Artificial Sequence: Synthetic peptide
  Seed: ILDTAGLEEY (NRAS Q61L)
ILDTAGLEEA

SEQ ID NO: 13939 - protein, 10 aa, Artificial Sequence
  Description of Artificial Sequence: Synthetic peptide
  Seed: ILDTAGLEEY (NRAS Q61L)
ILDTAGLEEC

SEQ ID NO: 13940 - protein, 10 aa, Artificial Sequence
  Description of Artificial Sequence: Synthetic peptide
  Seed: ILDTAGLEEY (NRAS Q61L)
ILDTAGLEEH

SEQ ID NO: 13941 - protein, 10 aa, Artificial Sequence
  Description of Artificial Sequence: Synthetic peptide
  Seed: ILDTAGLEEY (NRAS Q61L)
ILDTAGLEEI

SEQ ID NO: 13942 - protein, 10 aa, Artificial Sequence
  Description of Artificial Sequence: Synthetic peptide
  Seed: ILDTAGLEEY (NRAS Q61L)
ILDTAGLEEK

SEQ ID NO: 13943 - protein, 10 aa, Artificial Sequence
  Description of Artificial Sequence: Synthetic peptide
  Seed: ILDTAGLEEY (NRAS Q61L)
ILDTAGLEEL

SEQ ID NO: 13944 - protein, 10 aa, Artificial Sequence
  Description of Artificial Sequence: Synthetic peptide
  Seed: ILDTAGLEEY (NRAS Q61L)
ILDTAGLEEM

SEQ ID NO: 13945 - protein, 10 aa, Artificial Sequence
  Description of Artificial Sequence: Synthetic peptide
  Seed: ILDTAGLEEY (NRAS Q61L)
ILDTAGLEEQ

SEQ ID NO: 13946 - protein, 10 aa, Artificial Sequence
  Description of Artificial Sequence: Synthetic peptide
  Seed: ILDTAGLEEY (NRAS Q61L)
ILDTAGLEER

SEQ ID NO: 13947 - protein, 10 aa, Artificial Sequence
  Description of Artificial Sequence: Synthetic peptide
  Seed: ILDTAGLEEY (NRAS Q61L)
ILDTAGLEET

SEQ ID NO: 13948 - protein, 10 aa, Artificial Sequence
  Description of Artificial Sequence: Synthetic peptide
  Seed: ILDTAGLEEY (NRAS Q61L)
ILDTAGLEEV

SEQ ID NO: 13949 - protein, 10 aa, Artificial Sequence
  Description of Artificial Sequence: Synthetic peptide
  Seed: ILDTAGLEEY (NRAS Q61L)
ILDTAGLEEW

SEQ ID NO: 13950 - protein, 9 aa, Artificial Sequence
  Description of Artificial Sequence: Synthetic peptide
  Seed: ILDTAGLEE (NRAS Q61L)
ILDTAGLEF

SEQ ID NO: 13951 - protein, 9 aa, Artificial Sequence
  Description of Artificial Sequence: Synthetic peptide
  Seed: ILDTAGLEE (NRAS Q61L)
ILDTAGLEG

SEQ ID NO: 13952 - protein, 9 aa, Artificial Sequence
  Description of Artificial Sequence: Synthetic peptide
  Seed: ILDTAGLEE (NRAS Q61L)
ILDTAGLEI

SEQ ID NO: 13953 - protein, 9 aa, Artificial Sequence
  Description of Artificial Sequence: Synthetic peptide
  Seed: ILDTAGLEE (NRAS Q61L)
ILDTAGLEK

SEQ ID NO: 13954 - protein, 9 aa, Artificial Sequence
  Description of Artificial Sequence: Synthetic peptide
  Seed: ILDTAGLEE (NRAS Q61L)
ILDTAGLEL

SEQ ID NO: 13955 - protein, 9 aa, Artificial Sequence
  Description of Artificial Sequence: Synthetic peptide
  Seed: ILDTAGLEE (NRAS Q61L)
ILDTAGLEM

SEQ ID NO: 13956 - protein, 9 aa, Artificial Sequence
  Description of Artificial Sequence: Synthetic peptide
  Seed: ILDTAGLEE (NRAS Q61L)
ILDTAGLEP

SEQ ID NO: 13957 - protein, 9 aa, Artificial Sequence
  Description of Artificial Sequence: Synthetic peptide
  Seed: ILDTAGLEE (NRAS Q61L)
ILDTAGLEQ

SEQ ID NO: 13958 - protein, 9 aa, Artificial Sequence
  Description of Artificial Sequence: Synthetic peptide
  Seed: ILDTAGLEE (NRAS Q61L)
ILDTAGLER

SEQ ID NO: 13959 - protein, 9 aa, Artificial Sequence
  Description of Artificial Sequence: Synthetic peptide
  Seed: ILDTAGLEE (NRAS Q61L)
ILDTAGLES

SEQ ID NO: 13960 - protein, 9 aa, Artificial Sequence
  Description of Artificial Sequence: Synthetic peptide
  Seed: ILDTAGLEE (NRAS Q61L)
ILDTAGLET

SEQ ID NO: 13961 - protein, 9 aa, Artificial Sequence
  Description of Artificial Sequence: Synthetic peptide
  Seed: ILDTAGLEE (NRAS Q61L)
ILDTAGLEV

SEQ ID NO: 13962 - protein, 9 aa, Artificial Sequence
  Description of Artificial Sequence: Synthetic peptide
  Seed: ILDTAGLEE (NRAS Q61L)
ILDTAGLEW

SEQ ID NO: 13963 - protein, 9 aa, Artificial Sequence
  Description of Artificial Sequence: Synthetic peptide
  Seed: ILDTAGLEE (NRAS Q61L)
ILDTAGLEY

SEQ ID NO: 13964 - protein, 9 aa, Artificial Sequence
  Description of Artificial Sequence: Synthetic peptide
  Seed: ILDTAGLEE (NRAS Q61L)
IMDTAGLEA

SEQ ID NO: 13965 - protein, 9 aa, Artificial Sequence
  Description of Artificial Sequence: Synthetic peptide
  Seed: ILDTAGLEE (NRAS Q61L)
IMDTAGLEC

SEQ ID NO: 13966 - protein, 10 aa, Artificial Sequence
  Description of Artificial Sequence: Synthetic peptide
  Seed: ILDTAGLEEY (NRAS Q61L)
IMDTAGLEEA

SEQ ID NO: 13967 - protein, 10 aa, Artificial Sequence
  Description of Artificial Sequence: Synthetic peptide
  Seed: ILDTAGLEEY (NRAS Q61L)
IMDTAGLEEC

SEQ ID NO: 13968 - protein, 10 aa, Artificial Sequence
  Description of Artificial Sequence: Synthetic peptide
  Seed: ILDTAGLEEY (NRAS Q61L)
IMDTAGLEEH

SEQ ID NO: 13969 - protein, 10 aa, Artificial Sequence
  Description of Artificial Sequence: Synthetic peptide
  Seed: ILDTAGLEEY (NRAS Q61L)
IMDTAGLEEI

SEQ ID NO: 13970 - protein, 10 aa, Artificial Sequence
  Description of Artificial Sequence: Synthetic peptide
  Seed: ILDTAGLEEY (NRAS Q61L)
IMDTAGLEEK

SEQ ID NO: 13971 - protein, 10 aa, Artificial Sequence
  Description of Artificial Sequence: Synthetic peptide
  Seed: ILDTAGLEEY (NRAS Q61L)
IMDTAGLEEL

SEQ ID NO: 13972 - protein, 10 aa, Artificial Sequence
  Description of Artificial Sequence: Synthetic peptide
  Seed: ILDTAGLEEY (NRAS Q61L)
IMDTAGLEEQ

SEQ ID NO: 13973 - protein, 10 aa, Artificial Sequence
  Description of Artificial Sequence: Synthetic peptide
  Seed: ILDTAGLEEY (NRAS Q61L)
IMDTAGLEER

SEQ ID NO: 13974 - protein, 10 aa, Artificial Sequence
  Description of Artificial Sequence: Synthetic peptide
  Seed: ILDTAGLEEY (NRAS Q61L)
IMDTAGLEET

SEQ ID NO: 13975 - protein, 10 aa, Artificial Sequence
  Description of Artificial Sequence: Synthetic peptide
  Seed: ILDTAGLEEY (NRAS Q61L)
IMDTAGLEEV

SEQ ID NO: 13976 - protein, 10 aa, Artificial Sequence
  Description of Artificial Sequence: Synthetic peptide
  Seed: ILDTAGLEEY (NRAS Q61L)
IMDTAGLEEW

SEQ ID NO: 13977 - protein, 9 aa, Artificial Sequence
  Description of Artificial Sequence: Synthetic peptide
  Seed: ILDTAGLEE (NRAS Q61L)
IMDTAGLEF

SEQ ID NO: 13978 - protein, 9 aa, Artificial Sequence
  Description of Artificial Sequence: Synthetic peptide
  Seed: ILDTAGLEE (NRAS Q61L)
IMDTAGLEG

SEQ ID NO: 13979 - protein, 9 aa, Artificial Sequence
  Description of Artificial Sequence: Synthetic peptide
  Seed: ILDTAGLEE (NRAS Q61L)
IMDTAGLEI

SEQ ID NO: 13980 - protein, 9 aa, Artificial Sequence
  Description of Artificial Sequence: Synthetic peptide
  Seed: ILDTAGLEE (NRAS Q61L)
IMDTAGLEK

SEQ ID NO: 13981 - protein, 9 aa, Artificial Sequence
  Description of Artificial Sequence: Synthetic peptide
  Seed: ILDTAGLEE (NRAS Q61L)
IMDTAGLEL

SEQ ID NO: 13982 - protein, 9 aa, Artificial Sequence
  Description of Artificial Sequence: Synthetic peptide
  Seed: ILDTAGLEE (NRAS Q61L)
IMDTAGLEM

SEQ ID NO: 13983 - protein, 9 aa, Artificial Sequence
  Description of Artificial Sequence: Synthetic peptide
  Seed: ILDTAGLEE (NRAS Q61L)
IMDTAGLEP

SEQ ID NO: 13984 - protein, 9 aa, Artificial Sequence
  Description of Artificial Sequence: Synthetic peptide
  Seed: ILDTAGLEE (NRAS Q61L)
IMDTAGLEQ

SEQ ID NO: 13985 - protein, 9 aa, Artificial Sequence
  Description of Artificial Sequence: Synthetic peptide
  Seed: ILDTAGLEE (NRAS Q61L)
IMDTAGLER

SEQ ID NO: 13986 - protein, 9 aa, Artificial Sequence
  Description of Artificial Sequence: Synthetic peptide
  Seed: ILDTAGLEE (NRAS Q61L)
IMDTAGLES

SEQ ID NO: 13987 - protein, 9 aa, Artificial Sequence
  Description of Artificial Sequence: Synthetic peptide
  Seed: ILDTAGLEE (NRAS Q61L)
IMDTAGLET

SEQ ID NO: 13988 - protein, 9 aa, Artificial Sequence
  Description of Artificial Sequence: Synthetic peptide
  Seed: ILDTAGLEE (NRAS Q61L)
IMDTAGLEV

SEQ ID NO: 13989 - protein, 9 aa, Artificial Sequence
  Description of Artificial Sequence: Synthetic peptide
  Seed: ILDTAGLEE (NRAS Q61L)
IMDTAGLEW

SEQ ID NO: 13990 - protein, 9 aa, Artificial Sequence
  Description of Artificial Sequence: Synthetic peptide
  Seed: ILDTAGLEE (NRAS Q61L)
IMDTAGLEY

SEQ ID NO: 13991 - protein, 9 aa, Artificial Sequence
  Description of Artificial Sequence: Synthetic peptide
  Seed: ILDTAGLEE (NRAS Q61L)
INDTAGLEA

SEQ ID NO: 13992 - protein, 9 aa, Artificial Sequence
  Description of Artificial Sequence: Synthetic peptide
  Seed: ILDTAGLEE (NRAS Q61L)
INDTAGLEC

SEQ ID NO: 13993 - protein, 10 aa, Artificial Sequence
  Description of Artificial Sequence: Synthetic peptide
  Seed: ILDTAGLEEY (NRAS Q61L)
INDTAGLEEF

SEQ ID NO: 13994 - protein, 10 aa, Artificial Sequence
  Description of Artificial Sequence: Synthetic peptide
  Seed: ILDTAGLEEY (NRAS Q61L)
INDTAGLEEI

SEQ ID NO: 13995 - protein, 10 aa, Artificial Sequence
  Description of Artificial Sequence: Synthetic peptide
  Seed: ILDTAGLEEY (NRAS Q61L)
INDTAGLEEK

SEQ ID NO: 13996 - protein, 10 aa, Artificial Sequence
  Description of Artificial Sequence: Synthetic peptide
  Seed: ILDTAGLEEY (NRAS Q61L)
INDTAGLEEL

SEQ ID NO: 13997 - protein, 10 aa, Artificial Sequence
  Description of Artificial Sequence: Synthetic peptide
  Seed: ILDTAGLEEY (NRAS Q61L)
INDTAGLEEM

SEQ ID NO: 13998 - protein, 10 aa, Artificial Sequence
  Description of Artificial Sequence: Synthetic peptide
  Seed: ILDTAGLEEY (NRAS Q61L)
INDTAGLEER

SEQ ID NO: 13999 - protein, 10 aa, Artificial Sequence
  Description of Artificial Sequence: Synthetic peptide
  Seed: ILDTAGLEEY (NRAS Q61L)
INDTAGLEEV

SEQ ID NO: 14000 - protein, 9 aa, Artificial Sequence
  Description of Artificial Sequence: Synthetic peptide
  Seed: ILDTAGLEE (NRAS Q61L)
INDTAGLEF

SEQ ID NO: 14001 - protein, 9 aa, Artificial Sequence
  Description of Artificial Sequence: Synthetic peptide
  Seed: ILDTAGLEE (NRAS Q61L)
INDTAGLEI

SEQ ID NO: 14002 - protein, 9 aa, Artificial Sequence
  Description of Artificial Sequence: Synthetic peptide
  Seed: ILDTAGLEE (NRAS Q61L)
INDTAGLEL

SEQ ID NO: 14003 - protein, 9 aa, Artificial Sequence
  Description of Artificial Sequence: Synthetic peptide
  Seed: ILDTAGLEE (NRAS Q61L)
INDTAGLEM

SEQ ID NO: 14004 - protein, 9 aa, Artificial Sequence
  Description of Artificial Sequence: Synthetic peptide
  Seed: ILDTAGLEE (NRAS Q61L)
INDTAGLET

SEQ ID NO: 14005 - protein, 9 aa, Artificial Sequence
  Description of Artificial Sequence: Synthetic peptide
  Seed: ILDTAGLEE (NRAS Q61L)
INDTAGLEV

SEQ ID NO: 14006 - protein, 9 aa, Artificial Sequence
  Description of Artificial Sequence: Synthetic peptide
  Seed: ILDTAGLEE (NRAS Q61L)
INDTAGLEW

SEQ ID NO: 14007 - protein, 9 aa, Artificial Sequence
  Description of Artificial Sequence: Synthetic peptide
  Seed: ILDTAGLEE (NRAS Q61L)
INDTAGLEY

SEQ ID NO: 14008 - protein, 9 aa, Artificial Sequence
  Description of Artificial Sequence: Synthetic peptide
  Seed: ILDTAGLEE (NRAS Q61L)
IPDTAGLEA

SEQ ID NO: 14009 - protein, 9 aa, Artificial Sequence
  Description of Artificial Sequence: Synthetic peptide
  Seed: ILDTAGLEE (NRAS Q61L)
IPDTAGLEC

SEQ ID NO: 14010 - protein, 10 aa, Artificial Sequence
  Description of Artificial Sequence: Synthetic peptide
  Seed: ILDTAGLEEY (NRAS Q61L)
IPDTAGLEEA

SEQ ID NO: 14011 - protein, 10 aa, Artificial Sequence
  Description of Artificial Sequence: Synthetic peptide
  Seed: ILDTAGLEEY (NRAS Q61L)
IPDTAGLEEC

SEQ ID NO: 14012 - protein, 10 aa, Artificial Sequence
  Description of Artificial Sequence: Synthetic peptide
  Seed: ILDTAGLEEY (NRAS Q61L)
IPDTAGLEEF

SEQ ID NO: 14013 - protein, 10 aa, Artificial Sequence
  Description of Artificial Sequence: Synthetic peptide
  Seed: ILDTAGLEEY (NRAS Q61L)
IPDTAGLEEH

SEQ ID NO: 14014 - protein, 10 aa, Artificial Sequence
  Description of Artificial Sequence: Synthetic peptide
  Seed: ILDTAGLEEY (NRAS Q61L)
IPDTAGLEEI

SEQ ID NO: 14015 - protein, 10 aa, Artificial Sequence
  Description of Artificial Sequence: Synthetic peptide
  Seed: ILDTAGLEEY (NRAS Q61L)
IPDTAGLEEK

SEQ ID NO: 14016 - protein, 10 aa, Artificial Sequence
  Description of Artificial Sequence: Synthetic peptide
  Seed: ILDTAGLEEY (NRAS Q61L)
IPDTAGLEEL

SEQ ID NO: 14017 - protein, 10 aa, Artificial Sequence
  Description of Artificial Sequence: Synthetic peptide
  Seed: ILDTAGLEEY (NRAS Q61L)
IPDTAGLEEM

SEQ ID NO: 14018 - protein, 10 aa, Artificial Sequence
  Description of Artificial Sequence: Synthetic peptide
  Seed: ILDTAGLEEY (NRAS Q61L)
IPDTAGLEEV

SEQ ID NO: 14019 - protein, 10 aa, Artificial Sequence
  Description of Artificial Sequence: Synthetic peptide
  Seed: ILDTAGLEEY (NRAS Q61L)
IPDTAGLEEW

SEQ ID NO: 14020 - protein, 10 aa, Artificial Sequence
  Description of Artificial Sequence: Synthetic peptide
  Seed: ILDTAGLEEY (NRAS Q61L)
IPDTAGLEEY

SEQ ID NO: 14021 - protein, 9 aa, Artificial Sequence
  Description of Artificial Sequence: Synthetic peptide
  Seed: ILDTAGLEE (NRAS Q61L)
IPDTAGLEF

SEQ ID NO: 14022 - protein, 9 aa, Artificial Sequence
  Description of Artificial Sequence: Synthetic peptide
  Seed: ILDTAGLEE (NRAS Q61L)
IPDTAGLEI

SEQ ID NO: 14023 - protein, 9 aa, Artificial Sequence
  Description of Artificial Sequence: Synthetic peptide
  Seed: ILDTAGLEE (NRAS Q61L)
IPDTAGLEL

SEQ ID NO: 14024 - protein, 9 aa, Artificial Sequence
  Description of Artificial Sequence: Synthetic peptide
  Seed: ILDTAGLEE (NRAS Q61L)
IPDTAGLEM

SEQ ID NO: 14025 - protein, 9 aa, Artificial Sequence
  Description of Artificial Sequence: Synthetic peptide
  Seed: ILDTAGLEE (NRAS Q61L)
IPDTAGLET

SEQ ID NO: 14026 - protein, 9 aa, Artificial Sequence
  Description of Artificial Sequence: Synthetic peptide
  Seed: ILDTAGLEE (NRAS Q61L)
IPDTAGLEV

SEQ ID NO: 14027 - protein, 9 aa, Artificial Sequence
  Description of Artificial Sequence: Synthetic peptide
  Seed: ILDTAGLEE (NRAS Q61L)
IPDTAGLEW

SEQ ID NO: 14028 - protein, 9 aa, Artificial Sequence
  Description of Artificial Sequence: Synthetic peptide
  Seed: ILDTAGLEE (NRAS Q61L)
IPDTAGLEY

SEQ ID NO: 14029 - protein, 9 aa, Artificial Sequence
  Description of Artificial Sequence: Synthetic peptide
  Seed: ILDTAGLEE (NRAS Q61L)
IQDTAGLEA

SEQ ID NO: 14030 - protein, 9 aa, Artificial Sequence
  Description of Artificial Sequence: Synthetic peptide
  Seed: ILDTAGLEE (NRAS Q61L)
IQDTAGLEC

SEQ ID NO: 14031 - protein, 10 aa, Artificial Sequence
  Description of Artificial Sequence: Synthetic peptide
  Seed: ILDTAGLEEY (NRAS Q61L)
IQDTAGLEEC

SEQ ID NO: 14032 - protein, 10 aa, Artificial Sequence
  Description of Artificial Sequence: Synthetic peptide
  Seed: ILDTAGLEEY (NRAS Q61L)
IQDTAGLEEI

SEQ ID NO: 14033 - protein, 10 aa, Artificial Sequence
  Description of Artificial Sequence: Synthetic peptide
  Seed: ILDTAGLEEY (NRAS Q61L)
IQDTAGLEEK

SEQ ID NO: 14034 - protein, 10 aa, Artificial Sequence
  Description of Artificial Sequence: Synthetic peptide
  Seed: ILDTAGLEEY (NRAS Q61L)
IQDTAGLEEL

SEQ ID NO: 14035 - protein, 10 aa, Artificial Sequence
  Description of Artificial Sequence: Synthetic peptide
  Seed: ILDTAGLEEY (NRAS Q61L)
IQDTAGLEEM

SEQ ID NO: 14036 - protein, 10 aa, Artificial Sequence
  Description of Artificial Sequence: Synthetic peptide
  Seed: ILDTAGLEEY (NRAS Q61L)
IQDTAGLEER

SEQ ID NO: 14037 - protein, 10 aa, Artificial Sequence
  Description of Artificial Sequence: Synthetic peptide
  Seed: ILDTAGLEEY (NRAS Q61L)
IQDTAGLEEV

SEQ ID NO: 14038 - protein, 10 aa, Artificial Sequence
  Description of Artificial Sequence: Synthetic peptide
  Seed: ILDTAGLEEY (NRAS Q61L)
IQDTAGLEEW

SEQ ID NO: 14039 - protein, 9 aa, Artificial Sequence
  Description of Artificial Sequence: Synthetic peptide
  Seed: ILDTAGLEE (NRAS Q61L)
IQDTAGLEF

SEQ ID NO: 14040 - protein, 9 aa, Artificial Sequence
  Description of Artificial Sequence: Synthetic peptide
  Seed: ILDTAGLEE (NRAS Q61L)
IQDTAGLEI

SEQ ID NO: 14041 - protein, 9 aa, Artificial Sequence
  Description of Artificial Sequence: Synthetic peptide
  Seed: ILDTAGLEE (NRAS Q61L)
IQDTAGLEK

SEQ ID NO: 14042 - protein, 9 aa, Artificial Sequence
  Description of Artificial Sequence: Synthetic peptide
  Seed: ILDTAGLEE (NRAS Q61L)
IQDTAGLEL

SEQ ID NO: 14043 - protein, 9 aa, Artificial Sequence
  Description of Artificial Sequence: Synthetic peptide
  Seed: ILDTAGLEE (NRAS Q61L)
IQDTAGLEM

SEQ ID NO: 14044 - protein, 9 aa, Artificial Sequence
  Description of Artificial Sequence: Synthetic peptide
  Seed: ILDTAGLEE (NRAS Q61L)
IQDTAGLET

SEQ ID NO: 14045 - protein, 9 aa, Artificial Sequence
  Description of Artificial Sequence: Synthetic peptide
  Seed: ILDTAGLEE (NRAS Q61L)
IQDTAGLEV

SEQ ID NO: 14046 - protein, 9 aa, Artificial Sequence
  Description of Artificial Sequence: Synthetic peptide
  Seed: ILDTAGLEE (NRAS Q61L)
IQDTAGLEW

SEQ ID NO: 14047 - protein, 9 aa, Artificial Sequence
  Description of Artificial Sequence: Synthetic peptide
  Seed: ILDTAGLEE (NRAS Q61L)
IQDTAGLEY

SEQ ID NO: 14048 - protein, 10 aa, Artificial Sequence
  Description of Artificial Sequence: Synthetic peptide
  Seed: ILDTAGLEEY (NRAS Q61L)
IRDTAGLEEF

SEQ ID NO: 14049 - protein, 10 aa, Artificial Sequence
  Description of Artificial Sequence: Synthetic peptide
  Seed: ILDTAGLEEY (NRAS Q61L)
IRDTAGLEEL

SEQ ID NO: 14050 - protein, 10 aa, Artificial Sequence
  Description of Artificial Sequence: Synthetic peptide
  Seed: ILDTAGLEEY (NRAS Q61L)
IRDTAGLEEY

SEQ ID NO: 14051 - protein, 9 aa, Artificial Sequence
  Description of Artificial Sequence: Synthetic peptide
  Seed: ILDTAGLEE (NRAS Q61L)
IRDTAGLEF

SEQ ID NO: 14052 - protein, 9 aa, Artificial Sequence
  Description of Artificial Sequence: Synthetic peptide
  Seed: ILDTAGLEE (NRAS Q61L)
IRDTAGLEI

SEQ ID NO: 14053 - protein, 9 aa, Artificial Sequence
  Description of Artificial Sequence: Synthetic peptide
  Seed: ILDTAGLEE (NRAS Q61L)
IRDTAGLEL

SEQ ID NO: 14054 - protein, 9 aa, Artificial Sequence
  Description of Artificial Sequence: Synthetic peptide
  Seed: ILDTAGLEE (NRAS Q61L)
IRDTAGLEM

SEQ ID NO: 14055 - protein, 9 aa, Artificial Sequence
  Description of Artificial Sequence: Synthetic peptide
  Seed: ILDTAGLEE (NRAS Q61L)
IRDTAGLEV

SEQ ID NO: 14056 - protein, 9 aa, Artificial Sequence
  Description of Artificial Sequence: Synthetic peptide
  Seed: ILDTAGLEE (NRAS Q61L)
ISDTAGLEA

SEQ ID NO: 14057 - protein, 9 aa, Artificial Sequence
  Description of Artificial Sequence: Synthetic peptide
  Seed: ILDTAGLEE (NRAS Q61L)
ISDTAGLEC

SEQ ID NO: 14058 - protein, 9 aa, Artificial Sequence
  Description of Artificial Sequence: Synthetic peptide
  Seed: ILDTAGLEE (NRAS Q61L)
ISDTAGLEE

SEQ ID NO: 14059 - protein, 10 aa, Artificial Sequence
  Description of Artificial Sequence: Synthetic peptide
  Seed: ILDTAGLEEY (NRAS Q61L)
ISDTAGLEEA

SEQ ID NO: 14060 - protein, 10 aa, Artificial Sequence
  Description of Artificial Sequence: Synthetic peptide
  Seed: ILDTAGLEEY (NRAS Q61L)
ISDTAGLEEC

SEQ ID NO: 14061 - protein, 10 aa, Artificial Sequence
  Description of Artificial Sequence: Synthetic peptide
  Seed: ILDTAGLEEY (NRAS Q61L)
ISDTAGLEEF

SEQ ID NO: 14062 - protein, 10 aa, Artificial Sequence
  Description of Artificial Sequence: Synthetic peptide
  Seed: ILDTAGLEEY (NRAS Q61L)
ISDTAGLEEH

SEQ ID NO: 14063 - protein, 10 aa, Artificial Sequence
  Description of Artificial Sequence: Synthetic peptide
  Seed: ILDTAGLEEY (NRAS Q61L)
ISDTAGLEEI

SEQ ID NO: 14064 - protein, 10 aa, Artificial Sequence
  Description of Artificial Sequence: Synthetic peptide
  Seed: ILDTAGLEEY (NRAS Q61L)
ISDTAGLEEK

SEQ ID NO: 14065 - protein, 10 aa, Artificial Sequence
  Description of Artificial Sequence: Synthetic peptide
  Seed: ILDTAGLEEY (NRAS Q61L)
ISDTAGLEEL

SEQ ID NO: 14066 - protein, 10 aa, Artificial Sequence
  Description of Artificial Sequence: Synthetic peptide
  Seed: ILDTAGLEEY (NRAS Q61L)
ISDTAGLEEM

SEQ ID NO: 14067 - protein, 10 aa, Artificial Sequence
  Description of Artificial Sequence: Synthetic peptide
  Seed: ILDTAGLEEY (NRAS Q61L)
ISDTAGLEEQ

SEQ ID NO: 14068 - protein, 10 aa, Artificial Sequence
  Description of Artificial Sequence: Synthetic peptide
  Seed: ILDTAGLEEY (NRAS Q61L)
ISDTAGLEER

SEQ ID NO: 14069 - protein, 10 aa, Artificial Sequence
  Description of Artificial Sequence: Synthetic peptide
  Seed: ILDTAGLEEY (NRAS Q61L)
ISDTAGLEET

SEQ ID NO: 14070 - protein, 10 aa, Artificial Sequence
  Description of Artificial Sequence: Synthetic peptide
  Seed: ILDTAGLEEY (NRAS Q61L)
ISDTAGLEEV

SEQ ID NO: 14071 - protein, 10 aa, Artificial Sequence
  Description of Artificial Sequence: Synthetic peptide
  Seed: ILDTAGLEEY (NRAS Q61L)
ISDTAGLEEW

SEQ ID NO: 14072 - protein, 9 aa, Artificial Sequence
  Description of Artificial Sequence: Synthetic peptide
  Seed: ILDTAGLEE (NRAS Q61L)
ISDTAGLEF

SEQ ID NO: 14073 - protein, 9 aa, Artificial Sequence
  Description of Artificial Sequence: Synthetic peptide
  Seed: ILDTAGLEE (NRAS Q61L)
ISDTAGLEG

SEQ ID NO: 14074 - protein, 9 aa, Artificial Sequence
  Description of Artificial Sequence: Synthetic peptide
  Seed: ILDTAGLEE (NRAS Q61L)
ISDTAGLEH

SEQ ID NO: 14075 - protein, 9 aa, Artificial Sequence
  Description of Artificial Sequence: Synthetic peptide
  Seed: ILDTAGLEE (NRAS Q61L)
ISDTAGLEI

SEQ ID NO: 14076 - protein, 9 aa, Artificial Sequence
  Description of Artificial Sequence: Synthetic peptide
  Seed: ILDTAGLEE (NRAS Q61L)
ISDTAGLEK

SEQ ID NO: 14077 - protein, 9 aa, Artificial Sequence
  Description of Artificial Sequence: Synthetic peptide
  Seed: ILDTAGLEE (NRAS Q61L)
ISDTAGLEL

SEQ ID NO: 14078 - protein, 9 aa, Artificial Sequence
  Description of Artificial Sequence: Synthetic peptide
  Seed: ILDTAGLEE (NRAS Q61L)
ISDTAGLEM

SEQ ID NO: 14079 - protein, 9 aa, Artificial Sequence
  Description of Artificial Sequence: Synthetic peptide
  Seed: ILDTAGLEE (NRAS Q61L)
ISDTAGLEN

SEQ ID NO: 14080 - protein, 9 aa, Artificial Sequence
  Description of Artificial Sequence: Synthetic peptide
  Seed: ILDTAGLEE (NRAS Q61L)
ISDTAGLEP

SEQ ID NO: 14081 - protein, 9 aa, Artificial Sequence
  Description of Artificial Sequence: Synthetic peptide
  Seed: ILDTAGLEE (NRAS Q61L)
ISDTAGLEQ

SEQ ID NO: 14082 - protein, 9 aa, Artificial Sequence
  Description of Artificial Sequence: Synthetic peptide
  Seed: ILDTAGLEE (NRAS Q61L)
ISDTAGLER

SEQ ID NO: 14083 - protein, 9 aa, Artificial Sequence
  Description of Artificial Sequence: Synthetic peptide
  Seed: ILDTAGLEE (NRAS Q61L)
ISDTAGLES

SEQ ID NO: 14084 - protein, 9 aa, Artificial Sequence
  Description of Artificial Sequence: Synthetic peptide
  Seed: ILDTAGLEE (NRAS Q61L)
ISDTAGLET

SEQ ID NO: 14085 - protein, 9 aa, Artificial Sequence
  Description of Artificial Sequence: Synthetic peptide
  Seed: ILDTAGLEE (NRAS Q61L)
ISDTAGLEV

SEQ ID NO: 14086 - protein, 9 aa, Artificial Sequence
  Description of Artificial Sequence: Synthetic peptide
  Seed: ILDTAGLEE (NRAS Q61L)
ISDTAGLEW

SEQ ID NO: 14087 - protein, 9 aa, Artificial Sequence
  Description of Artificial Sequence: Synthetic peptide
  Seed: ILDTAGLEE (NRAS Q61L)
ISDTAGLEY

SEQ ID NO: 14088 - protein, 9 aa, Artificial Sequence
  Description of Artificial Sequence: Synthetic peptide
  Seed: ILDTAGLEE (NRAS Q61L)
ITDTAGLEA

SEQ ID NO: 14089 - protein, 9 aa, Artificial Sequence
  Description of Artificial Sequence: Synthetic peptide
  Seed: ILDTAGLEE (NRAS Q61L)
ITDTAGLEC

SEQ ID NO: 14090 - protein, 9 aa, Artificial Sequence
  Description of Artificial Sequence: Synthetic peptide
  Seed: ILDTAGLEE (NRAS Q61L)
ITDTAGLEE

SEQ ID NO: 14091 - protein, 10 aa, Artificial Sequence
  Description of Artificial Sequence: Synthetic peptide
  Seed: ILDTAGLEEY (NRAS Q61L)
ITDTAGLEEA

SEQ ID NO: 14092 - protein, 10 aa, Artificial Sequence
  Description of Artificial Sequence: Synthetic peptide
  Seed: ILDTAGLEEY (NRAS Q61L)
ITDTAGLEEC

SEQ ID NO: 14093 - protein, 10 aa, Artificial Sequence
  Description of Artificial Sequence: Synthetic peptide
  Seed: ILDTAGLEEY (NRAS Q61L)
ITDTAGLEEH

SEQ ID NO: 14094 - protein, 10 aa, Artificial Sequence
  Description of Artificial Sequence: Synthetic peptide
  Seed: ILDTAGLEEY (NRAS Q61L)
ITDTAGLEEI

SEQ ID NO: 14095 - protein, 10 aa, Artificial Sequence
  Description of Artificial Sequence: Synthetic peptide
  Seed: ILDTAGLEEY (NRAS Q61L)
ITDTAGLEEK

SEQ ID NO: 14096 - protein, 10 aa, Artificial Sequence
  Description of Artificial Sequence: Synthetic peptide
  Seed: ILDTAGLEEY (NRAS Q61L)
ITDTAGLEEL

SEQ ID NO: 14097 - protein, 10 aa, Artificial Sequence
  Description of Artificial Sequence: Synthetic peptide
  Seed: ILDTAGLEEY (NRAS Q61L)
ITDTAGLEEQ

SEQ ID NO: 14098 - protein, 10 aa, Artificial Sequence
  Description of Artificial Sequence: Synthetic peptide
  Seed: ILDTAGLEEY (NRAS Q61L)
ITDTAGLEER

SEQ ID NO: 14099 - protein, 10 aa, Artificial Sequence
  Description of Artificial Sequence: Synthetic peptide
  Seed: ILDTAGLEEY (NRAS Q61L)
ITDTAGLEET

SEQ ID NO: 14100 - protein, 10 aa, Artificial Sequence
  Description of Artificial Sequence: Synthetic peptide
  Seed: ILDTAGLEEY (NRAS Q61L)
ITDTAGLEEV

SEQ ID NO: 14101 - protein, 10 aa, Artificial Sequence
  Description of Artificial Sequence: Synthetic peptide
  Seed: ILDTAGLEEY (NRAS Q61L)
ITDTAGLEEW

SEQ ID NO: 14102 - protein, 9 aa, Artificial Sequence
  Description of Artificial Sequence: Synthetic peptide
  Seed: ILDTAGLEE (NRAS Q61L)
ITDTAGLEF

SEQ ID NO: 14103 - protein, 9 aa, Artificial Sequence
  Description of Artificial Sequence: Synthetic peptide
  Seed: ILDTAGLEE (NRAS Q61L)
ITDTAGLEG

SEQ ID NO: 14104 - protein, 9 aa, Artificial Sequence
  Description of Artificial Sequence: Synthetic peptide
  Seed: ILDTAGLEE (NRAS Q61L)
ITDTAGLEH

SEQ ID NO: 14105 - protein, 9 aa, Artificial Sequence
  Description of Artificial Sequence: Synthetic peptide
  Seed: ILDTAGLEE (NRAS Q61L)
ITDTAGLEI

SEQ ID NO: 14106 - protein, 9 aa, Artificial Sequence
  Description of Artificial Sequence: Synthetic peptide
  Seed: ILDTAGLEE (NRAS Q61L)
ITDTAGLEK

SEQ ID NO: 14107 - protein, 9 aa, Artificial Sequence
  Description of Artificial Sequence: Synthetic peptide
  Seed: ILDTAGLEE (NRAS Q61L)
ITDTAGLEL

SEQ ID NO: 14108 - protein, 9 aa, Artificial Sequence
  Description of Artificial Sequence: Synthetic peptide
  Seed: ILDTAGLEE (NRAS Q61L)
ITDTAGLEM

SEQ ID NO: 14109 - protein, 9 aa, Artificial Sequence
  Description of Artificial Sequence: Synthetic peptide
  Seed: ILDTAGLEE (NRAS Q61L)
ITDTAGLEP

SEQ ID NO: 14110 - protein, 9 aa, Artificial Sequence
  Description of Artificial Sequence: Synthetic peptide
  Seed: ILDTAGLEE (NRAS Q61L)
ITDTAGLEQ

SEQ ID NO: 14111 - protein, 9 aa, Artificial Sequence
  Description of Artificial Sequence: Synthetic peptide
  Seed: ILDTAGLEE (NRAS Q61L)
ITDTAGLER

SEQ ID NO: 14112 - protein, 9 aa, Artificial Sequence
  Description of Artificial Sequence: Synthetic peptide
  Seed: ILDTAGLEE (NRAS Q61L)
ITDTAGLES

SEQ ID NO: 14113 - protein, 9 aa, Artificial Sequence
  Description of Artificial Sequence: Synthetic peptide
  Seed: ILDTAGLEE (NRAS Q61L)
ITDTAGLET

SEQ ID NO: 14114 - protein, 9 aa, Artificial Sequence
  Description of Artificial Sequence: Synthetic peptide
  Seed: ILDTAGLEE (NRAS Q61L)
ITDTAGLEV

SEQ ID NO: 14115 - protein, 9 aa, Artificial Sequence
  Description of Artificial Sequence: Synthetic peptide
  Seed: ILDTAGLEE (NRAS Q61L)
ITDTAGLEW

SEQ ID NO: 14116 - protein, 9 aa, Artificial Sequence
  Description of Artificial Sequence: Synthetic peptide
  Seed: ILDTAGLEE (NRAS Q61L)
ITDTAGLEY

SEQ ID NO: 14117 - protein, 9 aa, Artificial Sequence
  Description of Artificial Sequence: Synthetic peptide
  Seed: ILDTAGLEE (NRAS Q61L)
IVDTAGLEA

SEQ ID NO: 14118 - protein, 9 aa, Artificial Sequence
  Description of Artificial Sequence: Synthetic peptide
  Seed: ILDTAGLEE (NRAS Q61L)
IVDTAGLEC

SEQ ID NO: 14119 - protein, 9 aa, Artificial Sequence
  Description of Artificial Sequence: Synthetic peptide
  Seed: ILDTAGLEE (NRAS Q61L)
IVDTAGLEE

SEQ ID NO: 14120 - protein, 10 aa, Artificial Sequence
  Description of Artificial Sequence: Synthetic peptide
  Seed: ILDTAGLEEY (NRAS Q61L)
IVDTAGLEEA

SEQ ID NO: 14121 - protein, 10 aa, Artificial Sequence
  Description of Artificial Sequence: Synthetic peptide
  Seed: ILDTAGLEEY (NRAS Q61L)
IVDTAGLEEC

SEQ ID NO: 14122 - protein, 10 aa, Artificial Sequence
  Description of Artificial Sequence: Synthetic peptide
  Seed: ILDTAGLEEY (NRAS Q61L)
IVDTAGLEEF

SEQ ID NO: 14123 - protein, 10 aa, Artificial Sequence
  Description of Artificial Sequence: Synthetic peptide
  Seed: ILDTAGLEEY (NRAS Q61L)
IVDTAGLEEH

SEQ ID NO: 14124 - protein, 10 aa, Artificial Sequence
  Description of Artificial Sequence: Synthetic peptide
  Seed: ILDTAGLEEY (NRAS Q61L)
IVDTAGLEEI

SEQ ID NO: 14125 - protein, 10 aa, Artificial Sequence
  Description of Artificial Sequence: Synthetic peptide
  Seed: ILDTAGLEEY (NRAS Q61L)
IVDTAGLEEK

SEQ ID NO: 14126 - protein, 10 aa, Artificial Sequence
  Description of Artificial Sequence: Synthetic peptide
  Seed: ILDTAGLEEY (NRAS Q61L)
IVDTAGLEEL

SEQ ID NO: 14127 - protein, 10 aa, Artificial Sequence
  Description of Artificial Sequence: Synthetic peptide
  Seed: ILDTAGLEEY (NRAS Q61L)
IVDTAGLEEM

SEQ ID NO: 14128 - protein, 10 aa, Artificial Sequence
  Description of Artificial Sequence: Synthetic peptide
  Seed: ILDTAGLEEY (NRAS Q61L)
IVDTAGLEEQ

SEQ ID NO: 14129 - protein, 10 aa, Artificial Sequence
  Description of Artificial Sequence: Synthetic peptide
  Seed: ILDTAGLEEY (NRAS Q61L)
IVDTAGLEER

SEQ ID NO: 14130 - protein, 10 aa, Artificial Sequence
  Description of Artificial Sequence: Synthetic peptide
  Seed: ILDTAGLEEY (NRAS Q61L)
IVDTAGLEET

SEQ ID NO: 14131 - protein, 10 aa, Artificial Sequence
  Description of Artificial Sequence: Synthetic peptide
  Seed: ILDTAGLEEY (NRAS Q61L)
IVDTAGLEEV

SEQ ID NO: 14132 - protein, 10 aa, Artificial Sequence
  Description of Artificial Sequence: Synthetic peptide
  Seed: ILDTAGLEEY (NRAS Q61L)
IVDTAGLEEW

SEQ ID NO: 14133 - protein, 9 aa, Artificial Sequence
  Description of Artificial Sequence: Synthetic peptide
  Seed: ILDTAGLEE (NRAS Q61L)
IVDTAGLEF

SEQ ID NO: 14134 - protein, 9 aa, Artificial Sequence
  Description of Artificial Sequence: Synthetic peptide
  Seed: ILDTAGLEE (NRAS Q61L)
IVDTAGLEG

SEQ ID NO: 14135 - protein, 9 aa, Artificial Sequence
  Description of Artificial Sequence: Synthetic peptide
  Seed: ILDTAGLEE (NRAS Q61L)
IVDTAGLEH

SEQ ID NO: 14136 - protein, 9 aa, Artificial Sequence
  Description of Artificial Sequence: Synthetic peptide
  Seed: ILDTAGLEE (NRAS Q61L)
IVDTAGLEI

SEQ ID NO: 14137 - protein, 9 aa, Artificial Sequence
  Description of Artificial Sequence: Synthetic peptide
  Seed: ILDTAGLEE (NRAS Q61L)
IVDTAGLEK

SEQ ID NO: 14138 - protein, 9 aa, Artificial Sequence
  Description of Artificial Sequence: Synthetic peptide
  Seed: ILDTAGLEE (NRAS Q61L)
IVDTAGLEL

SEQ ID NO: 14139 - protein, 9 aa, Artificial Sequence
  Description of Artificial Sequence: Synthetic peptide
  Seed: ILDTAGLEE (NRAS Q61L)
IVDTAGLEM

SEQ ID NO: 14140 - protein, 9 aa, Artificial Sequence
  Description of Artificial Sequence: Synthetic peptide
  Seed: ILDTAGLEE (NRAS Q61L)
IVDTAGLEP

SEQ ID NO: 14141 - protein, 9 aa, Artificial Sequence
  Description of Artificial Sequence: Synthetic peptide
  Seed: ILDTAGLEE (NRAS Q61L)
IVDTAGLEQ

SEQ ID NO: 14142 - protein, 9 aa, Artificial Sequence
  Description of Artificial Sequence: Synthetic peptide
  Seed: ILDTAGLEE (NRAS Q61L)
IVDTAGLER

SEQ ID NO: 14143 - protein, 9 aa, Artificial Sequence
  Description of Artificial Sequence: Synthetic peptide
  Seed: ILDTAGLEE (NRAS Q61L)
IVDTAGLES

SEQ ID NO: 14144 - protein, 9 aa, Artificial Sequence
  Description of Artificial Sequence: Synthetic peptide
  Seed: ILDTAGLEE (NRAS Q61L)
IVDTAGLET

SEQ ID NO: 14145 - protein, 9 aa, Artificial Sequence
  Description of Artificial Sequence: Synthetic peptide
  Seed: ILDTAGLEE (NRAS Q61L)
IVDTAGLEV

SEQ ID NO: 14146 - protein, 9 aa, Artificial Sequence
  Description of Artificial Sequence: Synthetic peptide
  Seed: ILDTAGLEE (NRAS Q61L)
IVDTAGLEW

SEQ ID NO: 14147 - protein, 9 aa, Artificial Sequence
  Description of Artificial Sequence: Synthetic peptide
  Seed: ILDTAGLEE (NRAS Q61L)
IVDTAGLEY

SEQ ID NO: 14148 - protein, 9 aa, Artificial Sequence
  Description of Artificial Sequence: Synthetic peptide
  Seed: ILDTAGLEE (NRAS Q61L)
IWDTAGLEA

SEQ ID NO: 14149 - protein, 9 aa, Artificial Sequence
  Description of Artificial Sequence: Synthetic peptide
  Seed: ILDTAGLEE (NRAS Q61L)
IWDTAGLEC

SEQ ID NO: 14150 - protein, 10 aa, Artificial Sequence
  Description of Artificial Sequence: Synthetic peptide
  Seed: ILDTAGLEEY (NRAS Q61L)
IWDTAGLEEA

SEQ ID NO: 14151 - protein, 10 aa, Artificial Sequence
  Description of Artificial Sequence: Synthetic peptide
  Seed: ILDTAGLEEY (NRAS Q61L)
IWDTAGLEEC

SEQ ID NO: 14152 - protein, 10 aa, Artificial Sequence
  Description of Artificial Sequence: Synthetic peptide
  Seed: ILDTAGLEEY (NRAS Q61L)
IWDTAGLEEF

SEQ ID NO: 14153 - protein, 10 aa, Artificial Sequence
  Description of Artificial Sequence: Synthetic peptide
  Seed: ILDTAGLEEY (NRAS Q61L)
IWDTAGLEEI

SEQ ID NO: 14154 - protein, 10 aa, Artificial Sequence
  Description of Artificial Sequence: Synthetic peptide
  Seed: ILDTAGLEEY (NRAS Q61L)
IWDTAGLEEK

SEQ ID NO: 14155 - protein, 10 aa, Artificial Sequence
  Description of Artificial Sequence: Synthetic peptide
  Seed: ILDTAGLEEY (NRAS Q61L)
IWDTAGLEEL

SEQ ID NO: 14156 - protein, 10 aa, Artificial Sequence
  Description of Artificial Sequence: Synthetic peptide
  Seed: ILDTAGLEEY (NRAS Q61L)
IWDTAGLEEM

SEQ ID NO: 14157 - protein, 10 aa, Artificial Sequence
  Description of Artificial Sequence: Synthetic peptide
  Seed: ILDTAGLEEY (NRAS Q61L)
IWDTAGLEER

SEQ ID NO: 14158 - protein, 10 aa, Artificial Sequence
  Description of Artificial Sequence: Synthetic peptide
  Seed: ILDTAGLEEY (NRAS Q61L)
IWDTAGLEET

SEQ ID NO: 14159 - protein, 10 aa, Artificial Sequence
  Description of Artificial Sequence: Synthetic peptide
  Seed: ILDTAGLEEY (NRAS Q61L)
IWDTAGLEEV

SEQ ID NO: 14160 - protein, 10 aa, Artificial Sequence
  Description of Artificial Sequence: Synthetic peptide
  Seed: ILDTAGLEEY (NRAS Q61L)
IWDTAGLEEW

SEQ ID NO: 14161 - protein, 9 aa, Artificial Sequence
  Description of Artificial Sequence: Synthetic peptide
  Seed: ILDTAGLEE (NRAS Q61L)
IWDTAGLEF

SEQ ID NO: 14162 - protein, 9 aa, Artificial Sequence
  Description of Artificial Sequence: Synthetic peptide
  Seed: ILDTAGLEE (NRAS Q61L)
IWDTAGLEI

SEQ ID NO: 14163 - protein, 9 aa, Artificial Sequence
  Description of Artificial Sequence: Synthetic peptide
  Seed: ILDTAGLEE (NRAS Q61L)
IWDTAGLEL

SEQ ID NO: 14164 - protein, 9 aa, Artificial Sequence
  Description of Artificial Sequence: Synthetic peptide
  Seed: ILDTAGLEE (NRAS Q61L)
IWDTAGLEM

SEQ ID NO: 14165 - protein, 9 aa, Artificial Sequence
  Description of Artificial Sequence: Synthetic peptide
  Seed: ILDTAGLEE (NRAS Q61L)
IWDTAGLET

SEQ ID NO: 14166 - protein, 9 aa, Artificial Sequence
  Description of Artificial Sequence: Synthetic peptide
  Seed: ILDTAGLEE (NRAS Q61L)
IWDTAGLEV

SEQ ID NO: 14167 - protein, 9 aa, Artificial Sequence
  Description of Artificial Sequence: Synthetic peptide
  Seed: ILDTAGLEE (NRAS Q61L)
IWDTAGLEW

SEQ ID NO: 14168 - protein, 9 aa, Artificial Sequence
  Description of Artificial Sequence: Synthetic peptide
  Seed: ILDTAGLEE (NRAS Q61L)
IWDTAGLEY

SEQ ID NO: 14169 - protein, 9 aa, Artificial Sequence
  Description of Artificial Sequence: Synthetic peptide
  Seed: ILDTAGLEE (NRAS Q61L)
IYDTAGLEA

SEQ ID NO: 14170 - protein, 9 aa, Artificial Sequence
  Description of Artificial Sequence: Synthetic peptide
  Seed: ILDTAGLEE (NRAS Q61L)
IYDTAGLEC

SEQ ID NO: 14171 - protein, 10 aa, Artificial Sequence
  Description of Artificial Sequence: Synthetic peptide
  Seed: ILDTAGLEEY (NRAS Q61L)
IYDTAGLEEA

SEQ ID NO: 14172 - protein, 10 aa, Artificial Sequence
  Description of Artificial Sequence: Synthetic peptide
  Seed: ILDTAGLEEY (NRAS Q61L)
IYDTAGLEEC

SEQ ID NO: 14173 - protein, 10 aa, Artificial Sequence
  Description of Artificial Sequence: Synthetic peptide
  Seed: ILDTAGLEEY (NRAS Q61L)
IYDTAGLEEF

SEQ ID NO: 14174 - protein, 10 aa, Artificial Sequence
  Description of Artificial Sequence: Synthetic peptide
  Seed: ILDTAGLEEY (NRAS Q61L)
IYDTAGLEEI

SEQ ID NO: 14175 - protein, 10 aa, Artificial Sequence
  Description of Artificial Sequence: Synthetic peptide
  Seed: ILDTAGLEEY (NRAS Q61L)
IYDTAGLEEK

SEQ ID NO: 14176 - protein, 10 aa, Artificial Sequence
  Description of Artificial Sequence: Synthetic peptide
  Seed: ILDTAGLEEY (NRAS Q61L)
IYDTAGLEEL

SEQ ID NO: 14177 - protein, 10 aa, Artificial Sequence
  Description of Artificial Sequence: Synthetic peptide
  Seed: ILDTAGLEEY (NRAS Q61L)
IYDTAGLEEM

SEQ ID NO: 14178 - protein, 10 aa, Artificial Sequence
  Description of Artificial Sequence: Synthetic peptide
  Seed: ILDTAGLEEY (NRAS Q61L)
IYDTAGLEER

SEQ ID NO: 14179 - protein, 10 aa, Artificial Sequence
  Description of Artificial Sequence: Synthetic peptide
  Seed: ILDTAGLEEY (NRAS Q61L)
IYDTAGLEET

SEQ ID NO: 14180 - protein, 10 aa, Artificial Sequence
  Description of Artificial Sequence: Synthetic peptide
  Seed: ILDTAGLEEY (NRAS Q61L)
IYDTAGLEEV

SEQ ID NO: 14181 - protein, 10 aa, Artificial Sequence
  Description of Artificial Sequence: Synthetic peptide
  Seed: ILDTAGLEEY (NRAS Q61L)
IYDTAGLEEW

SEQ ID NO: 14182 - protein, 9 aa, Artificial Sequence
  Description of Artificial Sequence: Synthetic peptide
  Seed: ILDTAGLEE (NRAS Q61L)
IYDTAGLEF

SEQ ID NO: 14183 - protein, 9 aa, Artificial Sequence
  Description of Artificial Sequence: Synthetic peptide
  Seed: ILDTAGLEE (NRAS Q61L)
IYDTAGLEI

SEQ ID NO: 14184 - protein, 9 aa, Artificial Sequence
  Description of Artificial Sequence: Synthetic peptide
  Seed: ILDTAGLEE (NRAS Q61L)
IYDTAGLEL

SEQ ID NO: 14185 - protein, 9 aa, Artificial Sequence
  Description of Artificial Sequence: Synthetic peptide
  Seed: ILDTAGLEE (NRAS Q61L)
IYDTAGLEM

SEQ ID NO: 14186 - protein, 9 aa, Artificial Sequence
  Description of Artificial Sequence: Synthetic peptide
  Seed: ILDTAGLEE (NRAS Q61L)
IYDTAGLET

SEQ ID NO: 14187 - protein, 9 aa, Artificial Sequence
  Description of Artificial Sequence: Synthetic peptide
  Seed: ILDTAGLEE (NRAS Q61L)
IYDTAGLEV

SEQ ID NO: 14188 - protein, 9 aa, Artificial Sequence
  Description of Artificial Sequence: Synthetic peptide
  Seed: ILDTAGLEE (NRAS Q61L)
IYDTAGLEW

SEQ ID NO: 14189 - protein, 9 aa, Artificial Sequence
  Description of Artificial Sequence: Synthetic peptide
  Seed: ILDTAGLEE (NRAS Q61L)
IYDTAGLEY

SEQ ID NO: 14190 - protein, 9 aa, Artificial Sequence
  Description of Artificial Sequence: Synthetic peptide
  Seed: LDTAGLEEY (NRAS Q61L)
LATAGLEEA

SEQ ID NO: 14191 - protein, 9 aa, Artificial Sequence
  Description of Artificial Sequence: Synthetic peptide
  Seed: LDTAGLEEY (NRAS Q61L)
LATAGLEEF

SEQ ID NO: 14192 - protein, 9 aa, Artificial Sequence
  Description of Artificial Sequence: Synthetic peptide
  Seed: LDTAGLEEY (NRAS Q61L)
LATAGLEEH

SEQ ID NO: 14193 - protein, 9 aa, Artificial Sequence
  Description of Artificial Sequence: Synthetic peptide
  Seed: LDTAGLEEY (NRAS Q61L)
LATAGLEEI

SEQ ID NO: 14194 - protein, 9 aa, Artificial Sequence
  Description of Artificial Sequence: Synthetic peptide
  Seed: LDTAGLEEY (NRAS Q61L)
LATAGLEEK

SEQ ID NO: 14195 - protein, 9 aa, Artificial Sequence
  Description of Artificial Sequence: Synthetic peptide
  Seed: LDTAGLEEY (NRAS Q61L)
LATAGLEEL

SEQ ID NO: 14196 - protein, 9 aa, Artificial Sequence
  Description of Artificial Sequence: Synthetic peptide
  Seed: LDTAGLEEY (NRAS Q61L)
LATAGLEEM

SEQ ID NO: 14197 - protein, 9 aa, Artificial Sequence
  Description of Artificial Sequence: Synthetic peptide
  Seed: LDTAGLEEY (NRAS Q61L)
LATAGLEER

SEQ ID NO: 14198 - protein, 9 aa, Artificial Sequence
  Description of Artificial Sequence: Synthetic peptide
  Seed: LDTAGLEEY (NRAS Q61L)
LATAGLEEV

SEQ ID NO: 14199 - protein, 9 aa, Artificial Sequence
  Description of Artificial Sequence: Synthetic peptide
  Seed: LDTAGLEEY (NRAS Q61L)
LATAGLEEW

SEQ ID NO: 14200 - protein, 9 aa, Artificial Sequence
  Description of Artificial Sequence: Synthetic peptide
  Seed: LDTAGLEEY (NRAS Q61L)
LATAGLEEY

SEQ ID NO: 14201 - protein, 9 aa, Artificial Sequence
  Description of Artificial Sequence: Synthetic peptide
  Seed: LDTAGLEEY (NRAS Q61L)
LCTAGLEEF

SEQ ID NO: 14202 - protein, 9 aa, Artificial Sequence
  Description of Artificial Sequence: Synthetic peptide
  Seed: LDTAGLEEY (NRAS Q61L)
LCTAGLEEM

SEQ ID NO: 14203 - protein, 9 aa, Artificial Sequence
  Description of Artificial Sequence: Synthetic peptide
  Seed: LDTAGLEEY (NRAS Q61L)
LCTAGLEEY

SEQ ID NO: 14204 - protein, 9 aa, Artificial Sequence
  Description of Artificial Sequence: Synthetic peptide
  Seed: LDTAGLEEY (NRAS Q61L)
LDTAGLEEF

SEQ ID NO: 14205 - protein, 9 aa, Artificial Sequence
  Description of Artificial Sequence: Synthetic peptide
  Seed: LDTAGLEEY (NRAS Q61L)
LDTAGLEEI

SEQ ID NO: 14206 - protein, 9 aa, Artificial Sequence
  Description of Artificial Sequence: Synthetic peptide
  Seed: LDTAGLEEY (NRAS Q61L)
LDTAGLEEK

SEQ ID NO: 14207 - protein, 9 aa, Artificial Sequence
  Description of Artificial Sequence: Synthetic peptide
  Seed: LDTAGLEEY (NRAS Q61L)
LDTAGLEEL

SEQ ID NO: 14208 - protein, 9 aa, Artificial Sequence
  Description of Artificial Sequence: Synthetic peptide
  Seed: LDTAGLEEY (NRAS Q61L)
LDTAGLEEM

SEQ ID NO: 14209 - protein, 9 aa, Artificial Sequence
  Description of Artificial Sequence: Synthetic peptide
  Seed: LDTAGLEEY (NRAS Q61L)
LDTAGLEEV

SEQ ID NO: 14210 - protein, 9 aa, Artificial Sequence
  Description of Artificial Sequence: Synthetic peptide
  Seed: LDTAGLEEY (NRAS Q61L)
LDTAGLEEW

SEQ ID NO: 14211 - protein, 11 aa, Artificial Sequence
  Description of Artificial Sequence: Synthetic peptide
  Seed: LEEYSAMRDQY (NRAS Q61L)
LEEYSAMRDQF

SEQ ID NO: 14212 - protein, 11 aa, Artificial Sequence
  Description of Artificial Sequence: Synthetic peptide
  Seed: LEEYSAMRDQY (NRAS Q61L)
LEEYSAMRDQW

SEQ ID NO: 14213 - protein, 9 aa, Artificial Sequence
  Description of Artificial Sequence: Synthetic peptide
  Seed: LDTAGLEEY (NRAS Q61L)
LETAGLEEA

SEQ ID NO: 14214 - protein, 9 aa, Artificial Sequence
  Description of Artificial Sequence: Synthetic peptide
  Seed: LDTAGLEEY (NRAS Q61L)
LETAGLEEC

SEQ ID NO: 14215 - protein, 9 aa, Artificial Sequence
  Description of Artificial Sequence: Synthetic peptide
  Seed: LDTAGLEEY (NRAS Q61L)
LETAGLEEH

SEQ ID NO: 14216 - protein, 9 aa, Artificial Sequence
  Description of Artificial Sequence: Synthetic peptide
  Seed: LDTAGLEEY (NRAS Q61L)
LETAGLEEI

SEQ ID NO: 14217 - protein, 9 aa, Artificial Sequence
  Description of Artificial Sequence: Synthetic peptide
  Seed: LDTAGLEEY (NRAS Q61L)
LETAGLEEK

SEQ ID NO: 14218 - protein, 9 aa, Artificial Sequence
  Description of Artificial Sequence: Synthetic peptide
  Seed: LDTAGLEEY (NRAS Q61L)
LETAGLEEL

SEQ ID NO: 14219 - protein, 9 aa, Artificial Sequence
  Description of Artificial Sequence: Synthetic peptide
  Seed: LDTAGLEEY (NRAS Q61L)
LETAGLEER

SEQ ID NO: 14220 - protein, 9 aa, Artificial Sequence
  Description of Artificial Sequence: Synthetic peptide
  Seed: LDTAGLEEY (NRAS Q61L)
LETAGLEEV

SEQ ID NO: 14221 - protein, 9 aa, Artificial Sequence
  Description of Artificial Sequence: Synthetic peptide
  Seed: LDTAGLEEY (NRAS Q61L)
LETAGLEEW

SEQ ID NO: 14222 - protein, 9 aa, Artificial Sequence
  Description of Artificial Sequence: Synthetic peptide
  Seed: LDTAGLEEY (NRAS Q61L)
LETAGLEEY

SEQ ID NO: 14223 - protein, 9 aa, Artificial Sequence
  Description of Artificial Sequence: Synthetic peptide
  Seed: LDTAGLEEY (NRAS Q61L)
LFTAGLEEF

SEQ ID NO: 14224 - protein, 9 aa, Artificial Sequence
  Description of Artificial Sequence: Synthetic peptide
  Seed: LDTAGLEEY (NRAS Q61L)
LFTAGLEEM

SEQ ID NO: 14225 - protein, 9 aa, Artificial Sequence
  Description of Artificial Sequence: Synthetic peptide
  Seed: LDTAGLEEY (NRAS Q61L)
LFTAGLEEY

SEQ ID NO: 14226 - protein, 9 aa, Artificial Sequence
  Description of Artificial Sequence: Synthetic peptide
  Seed: LDTAGLEEY (NRAS Q61L)
LGTAGLEEF

SEQ ID NO: 14227 - protein, 9 aa, Artificial Sequence
  Description of Artificial Sequence: Synthetic peptide
  Seed: LDTAGLEEY (NRAS Q61L)
LGTAGLEEH

SEQ ID NO: 14228 - protein, 9 aa, Artificial Sequence
  Description of Artificial Sequence: Synthetic peptide
  Seed: LDTAGLEEY (NRAS Q61L)
LGTAGLEEK

SEQ ID NO: 14229 - protein, 9 aa, Artificial Sequence
  Description of Artificial Sequence: Synthetic peptide
  Seed: LDTAGLEEY (NRAS Q61L)
LGTAGLEEL

SEQ ID NO: 14230 - protein, 9 aa, Artificial Sequence
  Description of Artificial Sequence: Synthetic peptide
  Seed: LDTAGLEEY (NRAS Q61L)
LGTAGLEEM

SEQ ID NO: 14231 - protein, 9 aa, Artificial Sequence
  Description of Artificial Sequence: Synthetic peptide
  Seed: LDTAGLEEY (NRAS Q61L)
LGTAGLEEY

SEQ ID NO: 14232 - protein, 9 aa, Artificial Sequence
  Description of Artificial Sequence: Synthetic peptide
  Seed: LDTAGLEEY (NRAS Q61L)
LHTAGLEEY

SEQ ID NO: 14233 - protein, 9 aa, Artificial Sequence
  Description of Artificial Sequence: Synthetic peptide
  Seed: LDTAGLEEY (NRAS Q61L)
LITAGLEEF

SEQ ID NO: 14234 - protein, 9 aa, Artificial Sequence
  Description of Artificial Sequence: Synthetic peptide
  Seed: LDTAGLEEY (NRAS Q61L)
LITAGLEEH

SEQ ID NO: 14235 - protein, 9 aa, Artificial Sequence
  Description of Artificial Sequence: Synthetic peptide
  Seed: LDTAGLEEY (NRAS Q61L)
LITAGLEEK

SEQ ID NO: 14236 - protein, 9 aa, Artificial Sequence
  Description of Artificial Sequence: Synthetic peptide
  Seed: LDTAGLEEY (NRAS Q61L)
LITAGLEEL

SEQ ID NO: 14237 - protein, 9 aa, Artificial Sequence
  Description of Artificial Sequence: Synthetic peptide
  Seed: LDTAGLEEY (NRAS Q61L)
LITAGLEEM

SEQ ID NO: 14238 - protein, 9 aa, Artificial Sequence
  Description of Artificial Sequence: Synthetic peptide
  Seed: LDTAGLEEY (NRAS Q61L)
LITAGLEER

SEQ ID NO: 14239 - protein, 9 aa, Artificial Sequence
  Description of Artificial Sequence: Synthetic peptide
  Seed: LDTAGLEEY (NRAS Q61L)
LITAGLEEY

SEQ ID NO: 14240 - protein, 9 aa, Artificial Sequence
  Description of Artificial Sequence: Synthetic peptide
  Seed: LDTAGLEEY (NRAS Q61L)
LKTAGLEEF

SEQ ID NO: 14241 - protein, 9 aa, Artificial Sequence
  Description of Artificial Sequence: Synthetic peptide
  Seed: LDTAGLEEY (NRAS Q61L)
LKTAGLEEY

SEQ ID NO: 14242 - protein, 9 aa, Artificial Sequence
  Description of Artificial Sequence: Synthetic peptide
  Seed: LDTAGLEEY (NRAS Q61L)
LLTAGLEEF

SEQ ID NO: 14243 - protein, 9 aa, Artificial Sequence
  Description of Artificial Sequence: Synthetic peptide
  Seed: LDTAGLEEY (NRAS Q61L)
LLTAGLEEK

SEQ ID NO: 14244 - protein, 9 aa, Artificial Sequence
  Description of Artificial Sequence: Synthetic peptide
  Seed: LDTAGLEEY (NRAS Q61L)
LLTAGLEEL

SEQ ID NO: 14245 - protein, 9 aa, Artificial Sequence
  Description of Artificial Sequence: Synthetic peptide
  Seed: LDTAGLEEY (NRAS Q61L)
LLTAGLEEM

SEQ ID NO: 14246 - protein, 9 aa, Artificial Sequence
  Description of Artificial Sequence: Synthetic peptide
  Seed: LDTAGLEEY (NRAS Q61L)
LLTAGLEEY

SEQ ID NO: 14247 - protein, 9 aa, Artificial Sequence
  Description of Artificial Sequence: Synthetic peptide
  Seed: LDTAGLEEY (NRAS Q61L)
LMTAGLEEF

SEQ ID NO: 14248 - protein, 9 aa, Artificial Sequence
  Description of Artificial Sequence: Synthetic peptide
  Seed: LDTAGLEEY (NRAS Q61L)
LMTAGLEEH

SEQ ID NO: 14249 - protein, 9 aa, Artificial Sequence
  Description of Artificial Sequence: Synthetic peptide
  Seed: LDTAGLEEY (NRAS Q61L)
LMTAGLEEI

SEQ ID NO: 14250 - protein, 9 aa, Artificial Sequence
  Description of Artificial Sequence: Synthetic peptide
  Seed: LDTAGLEEY (NRAS Q61L)
LMTAGLEEK

SEQ ID NO: 14251 - protein, 9 aa, Artificial Sequence
  Description of Artificial Sequence: Synthetic peptide
  Seed: LDTAGLEEY (NRAS Q61L)
LMTAGLEEL

SEQ ID NO: 14252 - protein, 9 aa, Artificial Sequence
  Description of Artificial Sequence: Synthetic peptide
  Seed: LDTAGLEEY (NRAS Q61L)
LMTAGLEEM

SEQ ID NO: 14253 - protein, 9 aa, Artificial Sequence
  Description of Artificial Sequence: Synthetic peptide
  Seed: LDTAGLEEY (NRAS Q61L)
LMTAGLEEV

SEQ ID NO: 14254 - protein, 9 aa, Artificial Sequence
  Description of Artificial Sequence: Synthetic peptide
  Seed: LDTAGLEEY (NRAS Q61L)
LMTAGLEEW

SEQ ID NO: 14255 - protein, 9 aa, Artificial Sequence
  Description of Artificial Sequence: Synthetic peptide
  Seed: LDTAGLEEY (NRAS Q61L)
LNTAGLEEF

SEQ ID NO: 14256 - protein, 9 aa, Artificial Sequence
  Description of Artificial Sequence: Synthetic peptide
  Seed: LDTAGLEEY (NRAS Q61L)
LNTAGLEEK

SEQ ID NO: 14257 - protein, 9 aa, Artificial Sequence
  Description of Artificial Sequence: Synthetic peptide
  Seed: LDTAGLEEY (NRAS Q61L)
LNTAGLEEM

SEQ ID NO: 14258 - protein, 9 aa, Artificial Sequence
  Description of Artificial Sequence: Synthetic peptide
  Seed: LDTAGLEEY (NRAS Q61L)
LNTAGLEEY

SEQ ID NO: 14259 - protein, 9 aa, Artificial Sequence
  Description of Artificial Sequence: Synthetic peptide
  Seed: LDTAGLEEY (NRAS Q61L)
LPTAGLEEF

SEQ ID NO: 14260 - protein, 9 aa, Artificial Sequence
  Description of Artificial Sequence: Synthetic peptide
  Seed: LDTAGLEEY (NRAS Q61L)
LPTAGLEEL

SEQ ID NO: 14261 - protein, 9 aa, Artificial Sequence
  Description of Artificial Sequence: Synthetic peptide
  Seed: LDTAGLEEY (NRAS Q61L)
LPTAGLEEM

SEQ ID NO: 14262 - protein, 9 aa, Artificial Sequence
  Description of Artificial Sequence: Synthetic peptide
  Seed: LDTAGLEEY (NRAS Q61L)
LPTAGLEEW

SEQ ID NO: 14263 - protein, 9 aa, Artificial Sequence
  Description of Artificial Sequence: Synthetic peptide
  Seed: LDTAGLEEY (NRAS Q61L)
LPTAGLEEY

SEQ ID NO: 14264 - protein, 9 aa, Artificial Sequence
  Description of Artificial Sequence: Synthetic peptide
  Seed: LDTAGLEEY (NRAS Q61L)
LQTAGLEEF

SEQ ID NO: 14265 - protein, 9 aa, Artificial Sequence
  Description of Artificial Sequence: Synthetic peptide
  Seed: LDTAGLEEY (NRAS Q61L)
LQTAGLEEH

SEQ ID NO: 14266 - protein, 9 aa, Artificial Sequence
  Description of Artificial Sequence: Synthetic peptide
  Seed: LDTAGLEEY (NRAS Q61L)
LQTAGLEEI

SEQ ID NO: 14267 - protein, 9 aa, Artificial Sequence
  Description of Artificial Sequence: Synthetic peptide
  Seed: LDTAGLEEY (NRAS Q61L)
LQTAGLEEK

SEQ ID NO: 14268 - protein, 9 aa, Artificial Sequence
  Description of Artificial Sequence: Synthetic peptide
  Seed: LDTAGLEEY (NRAS Q61L)
LQTAGLEEL

SEQ ID NO: 14269 - protein, 9 aa, Artificial Sequence
  Description of Artificial Sequence: Synthetic peptide
  Seed: LDTAGLEEY (NRAS Q61L)
LQTAGLEEM

SEQ ID NO: 14270 - protein, 9 aa, Artificial Sequence
  Description of Artificial Sequence: Synthetic peptide
  Seed: LDTAGLEEY (NRAS Q61L)
LQTAGLEEV

SEQ ID NO: 14271 - protein, 9 aa, Artificial Sequence
  Description of Artificial Sequence: Synthetic peptide
  Seed: LDTAGLEEY (NRAS Q61L)
LQTAGLEEW

SEQ ID NO: 14272 - protein, 9 aa, Artificial Sequence
  Description of Artificial Sequence: Synthetic peptide
  Seed: LDTAGLEEY (NRAS Q61L)
LQTAGLEEY

SEQ ID NO: 14273 - protein, 9 aa, Artificial Sequence
  Description of Artificial Sequence: Synthetic peptide
  Seed: LDTAGLEEY (NRAS Q61L)
LRTAGLEEF

SEQ ID NO: 14274 - protein, 9 aa, Artificial Sequence
  Description of Artificial Sequence: Synthetic peptide
  Seed: LDTAGLEEY (NRAS Q61L)
LRTAGLEEY

SEQ ID NO: 14275 - protein, 9 aa, Artificial Sequence
  Description of Artificial Sequence: Synthetic peptide
  Seed: LDTAGLEEY (NRAS Q61L)
LSTAGLEEF

SEQ ID NO: 14276 - protein, 9 aa, Artificial Sequence
  Description of Artificial Sequence: Synthetic peptide
  Seed: LDTAGLEEY (NRAS Q61L)
LSTAGLEEH

SEQ ID NO: 14277 - protein, 9 aa, Artificial Sequence
  Description of Artificial Sequence: Synthetic peptide
  Seed: LDTAGLEEY (NRAS Q61L)
LSTAGLEEI

SEQ ID NO: 14278 - protein, 9 aa, Artificial Sequence
  Description of Artificial Sequence: Synthetic peptide
  Seed: LDTAGLEEY (NRAS Q61L)
LSTAGLEEK

SEQ ID NO: 14279 - protein, 9 aa, Artificial Sequence
  Description of Artificial Sequence: Synthetic peptide
  Seed: LDTAGLEEY (NRAS Q61L)
LSTAGLEEL

SEQ ID NO: 14280 - protein, 9 aa, Artificial Sequence
  Description of Artificial Sequence: Synthetic peptide
  Seed: LDTAGLEEY (NRAS Q61L)
LSTAGLEEM

SEQ ID NO: 14281 - protein, 9 aa, Artificial Sequence
  Description of Artificial Sequence: Synthetic peptide
  Seed: LDTAGLEEY (NRAS Q61L)
LSTAGLEER

SEQ ID NO: 14282 - protein, 9 aa, Artificial Sequence
  Description of Artificial Sequence: Synthetic peptide
  Seed: LDTAGLEEY (NRAS Q61L)
LSTAGLEEV

SEQ ID NO: 14283 - protein, 9 aa, Artificial Sequence
  Description of Artificial Sequence: Synthetic peptide
  Seed: LDTAGLEEY (NRAS Q61L)
LSTAGLEEY

SEQ ID NO: 14284 - protein, 9 aa, Artificial Sequence
  Description of Artificial Sequence: Synthetic peptide
  Seed: LDTAGLEEY (NRAS Q61L)
LTTAGLEEF

SEQ ID NO: 14285 - protein, 9 aa, Artificial Sequence
  Description of Artificial Sequence: Synthetic peptide
  Seed: LDTAGLEEY (NRAS Q61L)
LTTAGLEEH

SEQ ID NO: 14286 - protein, 9 aa, Artificial Sequence
  Description of Artificial Sequence: Synthetic peptide
  Seed: LDTAGLEEY (NRAS Q61L)
LTTAGLEEI

SEQ ID NO: 14287 - protein, 9 aa, Artificial Sequence
  Description of Artificial Sequence: Synthetic peptide
  Seed: LDTAGLEEY (NRAS Q61L)
LTTAGLEEK

SEQ ID NO: 14288 - protein, 9 aa, Artificial Sequence
  Description of Artificial Sequence: Synthetic peptide
  Seed: LDTAGLEEY (NRAS Q61L)
LTTAGLEEL

SEQ ID NO: 14289 - protein, 9 aa, Artificial Sequence
  Description of Artificial Sequence: Synthetic peptide
  Seed: LDTAGLEEY (NRAS Q61L)
LTTAGLEEM

SEQ ID NO: 14290 - protein, 9 aa, Artificial Sequence
  Description of Artificial Sequence: Synthetic peptide
  Seed: LDTAGLEEY (NRAS Q61L)
LTTAGLEER

SEQ ID NO: 14291 - protein, 9 aa, Artificial Sequence
  Description of Artificial Sequence: Synthetic peptide
  Seed: LDTAGLEEY (NRAS Q61L)
LTTAGLEEV

SEQ ID NO: 14292 - protein, 9 aa, Artificial Sequence
  Description of Artificial Sequence: Synthetic peptide
  Seed: LDTAGLEEY (NRAS Q61L)
LTTAGLEEY

SEQ ID NO: 14293 - protein, 9 aa, Artificial Sequence
  Description of Artificial Sequence: Synthetic peptide
  Seed: LDTAGLEEY (NRAS Q61L)
LVTAGLEEF

SEQ ID NO: 14294 - protein, 9 aa, Artificial Sequence
  Description of Artificial Sequence: Synthetic peptide
  Seed: LDTAGLEEY (NRAS Q61L)
LVTAGLEEH

SEQ ID NO: 14295 - protein, 9 aa, Artificial Sequence
  Description of Artificial Sequence: Synthetic peptide
  Seed: LDTAGLEEY (NRAS Q61L)
LVTAGLEEI

SEQ ID NO: 14296 - protein, 9 aa, Artificial Sequence
  Description of Artificial Sequence: Synthetic peptide
  Seed: LDTAGLEEY (NRAS Q61L)
LVTAGLEEK

SEQ ID NO: 14297 - protein, 9 aa, Artificial Sequence
  Description of Artificial Sequence: Synthetic peptide
  Seed: LDTAGLEEY (NRAS Q61L)
LVTAGLEEL

SEQ ID NO: 14298 - protein, 9 aa, Artificial Sequence
  Description of Artificial Sequence: Synthetic peptide
  Seed: LDTAGLEEY (NRAS Q61L)
LVTAGLEEM

SEQ ID NO: 14299 - protein, 9 aa, Artificial Sequence
  Description of Artificial Sequence: Synthetic peptide
  Seed: LDTAGLEEY (NRAS Q61L)
LVTAGLEER

SEQ ID NO: 14300 - protein, 9 aa, Artificial Sequence
  Description of Artificial Sequence: Synthetic peptide
  Seed: LDTAGLEEY (NRAS Q61L)
LVTAGLEEV

SEQ ID NO: 14301 - protein, 9 aa, Artificial Sequence
  Description of Artificial Sequence: Synthetic peptide
  Seed: LDTAGLEEY (NRAS Q61L)
LVTAGLEEY

SEQ ID NO: 14302 - protein, 9 aa, Artificial Sequence
  Description of Artificial Sequence: Synthetic peptide
  Seed: LDTAGLEEY (NRAS Q61L)
LWTAGLEEF

SEQ ID NO: 14303 - protein, 9 aa, Artificial Sequence
  Description of Artificial Sequence: Synthetic peptide
  Seed: LDTAGLEEY (NRAS Q61L)
LWTAGLEEY

SEQ ID NO: 14304 - protein, 9 aa, Artificial Sequence
  Description of Artificial Sequence: Synthetic peptide
  Seed: LDTAGLEEY (NRAS Q61L)
LYTAGLEEF

SEQ ID NO: 14305 - protein, 9 aa, Artificial Sequence
  Description of Artificial Sequence: Synthetic peptide
  Seed: LDTAGLEEY (NRAS Q61L)
LYTAGLEEY

SEQ ID NO: 14306 - protein, 9 aa, Homo sapiens
  Native (NRAS Q61L)
AGLEEYSAM

SEQ ID NO: 14307 - protein, 10 aa, Homo sapiens
  Native (NRAS Q61L)
AGLEEYSAMR

SEQ ID NO: 14308 - protein, 10 aa, Homo sapiens
  Native (NRAS Q61L)
DTAGLEEYSA

SEQ ID NO: 14309 - protein, 11 aa, Homo sapiens
  Native (NRAS Q61L)
DTAGLEEYSAM

SEQ ID NO: 14310 - protein, 10 aa, Homo sapiens
  Native (NRAS Q61L)
ILDTAGLEEY

SEQ ID NO: 14311 - protein, 11 aa, Homo sapiens
  Native (NRAS Q61L)
DILDTAGLEEY

SEQ ID NO: 14312 - protein, 9 aa, Homo sapiens
  Native (NRAS Q61L)
ILDTAGLEE

SEQ ID NO: 14313 - protein, 9 aa, Homo sapiens
  Native (NRAS Q61L)
LDTAGLEEY

SEQ ID NO: 14314 - protein, 11 aa, Homo sapiens
  Native (NRAS Q61L)
LEEYSAMRDQY

SEQ ID NO: 14315 - protein, 9 aa, Artificial Sequence
  Description of Artificial Sequence: Synthetic peptide
  Seed: AGREEYSAM (NRAS Q61R)
AAREEYSAF

SEQ ID NO: 14316 - protein, 9 aa, Artificial Sequence
  Description of Artificial Sequence: Synthetic peptide
  Seed: AGREEYSAM (NRAS Q61R)
AAREEYSAM

SEQ ID NO: 14317 - protein, 10 aa, Artificial Sequence
  Description of Artificial Sequence: Synthetic peptide
  Seed: AGREEYSAMR (NRAS Q61R)
AAREEYSAMR

SEQ ID NO: 14318 - protein, 9 aa, Artificial Sequence
  Description of Artificial Sequence: Synthetic peptide
  Seed: AGREEYSAM (NRAS Q61R)
ACREEYSAF

SEQ ID NO: 14319 - protein, 9 aa, Artificial Sequence
  Description of Artificial Sequence: Synthetic peptide
  Seed: AGREEYSAM (NRAS Q61R)
ACREEYSAY

SEQ ID NO: 14320 - protein, 9 aa, Artificial Sequence
  Description of Artificial Sequence: Synthetic peptide
  Seed: AGREEYSAM (NRAS Q61R)
AEREEYSAF

SEQ ID NO: 14321 - protein, 9 aa, Artificial Sequence
  Description of Artificial Sequence: Synthetic peptide
  Seed: AGREEYSAM (NRAS Q61R)
AEREEYSAL

SEQ ID NO: 14322 - protein, 9 aa, Artificial Sequence
  Description of Artificial Sequence: Synthetic peptide
  Seed: AGREEYSAM (NRAS Q61R)
AEREEYSAM

SEQ ID NO: 14323 - protein, 9 aa, Artificial Sequence
  Description of Artificial Sequence: Synthetic peptide
  Seed: AGREEYSAM (NRAS Q61R)
AEREEYSAY

SEQ ID NO: 14324 - protein, 9 aa, Artificial Sequence
  Description of Artificial Sequence: Synthetic peptide
  Seed: AGREEYSAM (NRAS Q61R)
AFREEYSAF

SEQ ID NO: 14325 - protein, 9 aa, Artificial Sequence
  Description of Artificial Sequence: Synthetic peptide
  Seed: AGREEYSAM (NRAS Q61R)
AFREEYSAM

SEQ ID NO: 14326 - protein, 10 aa, Artificial Sequence
  Description of Artificial Sequence: Synthetic peptide
  Seed: AGREEYSAMR (NRAS Q61R)
AFREEYSAMK

SEQ ID NO: 14327 - protein, 10 aa, Artificial Sequence
  Description of Artificial Sequence: Synthetic peptide
  Seed: AGREEYSAMR (NRAS Q61R)
AFREEYSAMR

SEQ ID NO: 14328 - protein, 9 aa, Artificial Sequence
  Description of Artificial Sequence: Synthetic peptide
  Seed: AGREEYSAM (NRAS Q61R)
AFREEYSAY

SEQ ID NO: 14329 - protein, 9 aa, Artificial Sequence
  Description of Artificial Sequence: Synthetic peptide
  Seed: AGREEYSAM (NRAS Q61R)
AGREEYSAF

SEQ ID NO: 14330 - protein, 9 aa, Artificial Sequence
  Description of Artificial Sequence: Synthetic peptide
  Seed: AGREEYSAM (NRAS Q61R)
AGREEYSAY

SEQ ID NO: 14331 - protein, 9 aa, Artificial Sequence
  Description of Artificial Sequence: Synthetic peptide
  Seed: AGREEYSAM (NRAS Q61R)
AHREEYSAF

SEQ ID NO: 14332 - protein, 9 aa, Artificial Sequence
  Description of Artificial Sequence: Synthetic peptide
  Seed: AGREEYSAM (NRAS Q61R)
AHREEYSAH

SEQ ID NO: 14333 - protein, 9 aa, Artificial Sequence
  Description of Artificial Sequence: Synthetic peptide
  Seed: AGREEYSAM (NRAS Q61R)
AHREEYSAI

SEQ ID NO: 14334 - protein, 9 aa, Artificial Sequence
  Description of Artificial Sequence: Synthetic peptide
  Seed: AGREEYSAM (NRAS Q61R)
AHREEYSAL

SEQ ID NO: 14335 - protein, 9 aa, Artificial Sequence
  Description of Artificial Sequence: Synthetic peptide
  Seed: AGREEYSAM (NRAS Q61R)
AHREEYSAM

SEQ ID NO: 14336 - protein, 9 aa, Artificial Sequence
  Description of Artificial Sequence: Synthetic peptide
  Seed: AGREEYSAM (NRAS Q61R)
AHREEYSAW

SEQ ID NO: 14337 - protein, 9 aa, Artificial Sequence
  Description of Artificial Sequence: Synthetic peptide
  Seed: AGREEYSAM (NRAS Q61R)
AHREEYSAY

SEQ ID NO: 14338 - protein, 9 aa, Artificial Sequence
  Description of Artificial Sequence: Synthetic peptide
  Seed: AGREEYSAM (NRAS Q61R)
AIREEYSAF

SEQ ID NO: 14339 - protein, 9 aa, Artificial Sequence
  Description of Artificial Sequence: Synthetic peptide
  Seed: AGREEYSAM (NRAS Q61R)
AIREEYSAM

SEQ ID NO: 14340 - protein, 10 aa, Artificial Sequence
  Description of Artificial Sequence: Synthetic peptide
  Seed: AGREEYSAMR (NRAS Q61R)
AIREEYSAMR

SEQ ID NO: 14341 - protein, 9 aa, Artificial Sequence
  Description of Artificial Sequence: Synthetic peptide
  Seed: AGREEYSAM (NRAS Q61R)
AIREEYSAY

SEQ ID NO: 14342 - protein, 9 aa, Artificial Sequence
  Description of Artificial Sequence: Synthetic peptide
  Seed: AGREEYSAM (NRAS Q61R)
AKREEYSAF

SEQ ID NO: 14343 - protein, 9 aa, Artificial Sequence
  Description of Artificial Sequence: Synthetic peptide
  Seed: AGREEYSAM (NRAS Q61R)
AKREEYSAH

SEQ ID NO: 14344 - protein, 9 aa, Artificial Sequence
  Description of Artificial Sequence: Synthetic peptide
  Seed: AGREEYSAM (NRAS Q61R)
AKREEYSAI

SEQ ID NO: 14345 - protein, 9 aa, Artificial Sequence
  Description of Artificial Sequence: Synthetic peptide
  Seed: AGREEYSAM (NRAS Q61R)
AKREEYSAL

SEQ ID NO: 14346 - protein, 9 aa, Artificial Sequence
  Description of Artificial Sequence: Synthetic peptide
  Seed: AGREEYSAM (NRAS Q61R)
AKREEYSAM

SEQ ID NO: 14347 - protein, 9 aa, Artificial Sequence
  Description of Artificial Sequence: Synthetic peptide
  Seed: AGREEYSAM (NRAS Q61R)
AKREEYSAV

SEQ ID NO: 14348 - protein, 9 aa, Artificial Sequence
  Description of Artificial Sequence: Synthetic peptide
  Seed: AGREEYSAM (NRAS Q61R)
AKREEYSAW

SEQ ID NO: 14349 - protein, 9 aa, Artificial Sequence
  Description of Artificial Sequence: Synthetic peptide
  Seed: AGREEYSAM (NRAS Q61R)
AKREEYSAY

SEQ ID NO: 14350 - protein, 9 aa, Artificial Sequence
  Description of Artificial Sequence: Synthetic peptide
  Seed: AGREEYSAM (NRAS Q61R)
ALREEYSAF

SEQ ID NO: 14351 - protein, 9 aa, Artificial Sequence
  Description of Artificial Sequence: Synthetic peptide
  Seed: AGREEYSAM (NRAS Q61R)
ALREEYSAL

SEQ ID NO: 14352 - protein, 9 aa, Artificial Sequence
  Description of Artificial Sequence: Synthetic peptide
  Seed: AGREEYSAM (NRAS Q61R)
ALREEYSAM

SEQ ID NO: 14353 - protein, 10 aa, Artificial Sequence
  Description of Artificial Sequence: Synthetic peptide
  Seed: AGREEYSAMR (NRAS Q61R)
ALREEYSAMR

SEQ ID NO: 14354 - protein, 9 aa, Artificial Sequence
  Description of Artificial Sequence: Synthetic peptide
  Seed: AGREEYSAM (NRAS Q61R)
ALREEYSAW

SEQ ID NO: 14355 - protein, 9 aa, Artificial Sequence
  Description of Artificial Sequence: Synthetic peptide
  Seed: AGREEYSAM (NRAS Q61R)
ALREEYSAY

SEQ ID NO: 14356 - protein, 9 aa, Artificial Sequence
  Description of Artificial Sequence: Synthetic peptide
  Seed: AGREEYSAM (NRAS Q61R)
AMREEYSAA

SEQ ID NO: 14357 - protein, 9 aa, Artificial Sequence
  Description of Artificial Sequence: Synthetic peptide
  Seed: AGREEYSAM (NRAS Q61R)
AMREEYSAF

SEQ ID NO: 14358 - protein, 9 aa, Artificial Sequence
  Description of Artificial Sequence: Synthetic peptide
  Seed: AGREEYSAM (NRAS Q61R)
AMREEYSAH

SEQ ID NO: 14359 - protein, 9 aa, Artificial Sequence
  Description of Artificial Sequence: Synthetic peptide
  Seed: AGREEYSAM (NRAS Q61R)
AMREEYSAI

SEQ ID NO: 14360 - protein, 9 aa, Artificial Sequence
  Description of Artificial Sequence: Synthetic peptide
  Seed: AGREEYSAM (NRAS Q61R)
AMREEYSAL

SEQ ID NO: 14361 - protein, 9 aa, Artificial Sequence
  Description of Artificial Sequence: Synthetic peptide
  Seed: AGREEYSAM (NRAS Q61R)
AMREEYSAM

SEQ ID NO: 14362 - protein, 10 aa, Artificial Sequence
  Description of Artificial Sequence: Synthetic peptide
  Seed: AGREEYSAMR (NRAS Q61R)
AMREEYSAMK

SEQ ID NO: 14363 - protein, 9 aa, Artificial Sequence
  Description of Artificial Sequence: Synthetic peptide
  Seed: AGREEYSAM (NRAS Q61R)
AMREEYSAV

SEQ ID NO: 14364 - protein, 9 aa, Artificial Sequence
  Description of Artificial Sequence: Synthetic peptide
  Seed: AGREEYSAM (NRAS Q61R)
AMREEYSAW

SEQ ID NO: 14365 - protein, 9 aa, Artificial Sequence
  Description of Artificial Sequence: Synthetic peptide
  Seed: AGREEYSAM (NRAS Q61R)
AMREEYSAY

SEQ ID NO: 14366 - protein, 9 aa, Artificial Sequence
  Description of Artificial Sequence: Synthetic peptide
  Seed: AGREEYSAM (NRAS Q61R)
ANREEYSAF

SEQ ID NO: 14367 - protein, 9 aa, Artificial Sequence
  Description of Artificial Sequence: Synthetic peptide
  Seed: AGREEYSAM (NRAS Q61R)
ANREEYSAM

SEQ ID NO: 14368 - protein, 9 aa, Artificial Sequence
  Description of Artificial Sequence: Synthetic peptide
  Seed: AGREEYSAM (NRAS Q61R)
ANREEYSAY

SEQ ID NO: 14369 - protein, 9 aa, Artificial Sequence
  Description of Artificial Sequence: Synthetic peptide
  Seed: AGREEYSAM (NRAS Q61R)
APREEYSAF

SEQ ID NO: 14370 - protein, 9 aa, Artificial Sequence
  Description of Artificial Sequence: Synthetic peptide
  Seed: AGREEYSAM (NRAS Q61R)
APREEYSAY

SEQ ID NO: 14371 - protein, 9 aa, Artificial Sequence
  Description of Artificial Sequence: Synthetic peptide
  Seed: AGREEYSAM (NRAS Q61R)
AQREEYSAA

SEQ ID NO: 14372 - protein, 9 aa, Artificial Sequence
  Description of Artificial Sequence: Synthetic peptide
  Seed: AGREEYSAM (NRAS Q61R)
AQREEYSAC

SEQ ID NO: 14373 - protein, 9 aa, Artificial Sequence
  Description of Artificial Sequence: Synthetic peptide
  Seed: AGREEYSAM (NRAS Q61R)
AQREEYSAG

SEQ ID NO: 14374 - protein, 9 aa, Artificial Sequence
  Description of Artificial Sequence: Synthetic peptide
  Seed: AGREEYSAM (NRAS Q61R)
AQREEYSAH

SEQ ID NO: 14375 - protein, 9 aa, Artificial Sequence
  Description of Artificial Sequence: Synthetic peptide
  Seed: AGREEYSAM (NRAS Q61R)
AQREEYSAI

SEQ ID NO: 14376 - protein, 9 aa, Artificial Sequence
  Description of Artificial Sequence: Synthetic peptide
  Seed: AGREEYSAM (NRAS Q61R)
AQREEYSAL

SEQ ID NO: 14377 - protein, 9 aa, Artificial Sequence
  Description of Artificial Sequence: Synthetic peptide
  Seed: AGREEYSAM (NRAS Q61R)
AQREEYSAM

SEQ ID NO: 14378 - protein, 10 aa, Artificial Sequence
  Description of Artificial Sequence: Synthetic peptide
  Seed: AGREEYSAMR (NRAS Q61R)
AQREEYSAMR

SEQ ID NO: 14379 - protein, 9 aa, Artificial Sequence
  Description of Artificial Sequence: Synthetic peptide
  Seed: AGREEYSAM (NRAS Q61R)
AQREEYSAQ

SEQ ID NO: 14380 - protein, 9 aa, Artificial Sequence
  Description of Artificial Sequence: Synthetic peptide
  Seed: AGREEYSAM (NRAS Q61R)
AQREEYSAS

SEQ ID NO: 14381 - protein, 9 aa, Artificial Sequence
  Description of Artificial Sequence: Synthetic peptide
  Seed: AGREEYSAM (NRAS Q61R)
AQREEYSAT

SEQ ID NO: 14382 - protein, 9 aa, Artificial Sequence
  Description of Artificial Sequence: Synthetic peptide
  Seed: AGREEYSAM (NRAS Q61R)
AQREEYSAV

SEQ ID NO: 14383 - protein, 9 aa, Artificial Sequence
  Description of Artificial Sequence: Synthetic peptide
  Seed: AGREEYSAM (NRAS Q61R)
AQREEYSAW

SEQ ID NO: 14384 - protein, 9 aa, Artificial Sequence
  Description of Artificial Sequence: Synthetic peptide
  Seed: AGREEYSAM (NRAS Q61R)
AQREEYSAY

SEQ ID NO: 14385 - protein, 9 aa, Artificial Sequence
  Description of Artificial Sequence: Synthetic peptide
  Seed: AGREEYSAM (NRAS Q61R)
ARREEYSAM

SEQ ID NO: 14386 - protein, 9 aa, Artificial Sequence
  Description of Artificial Sequence: Synthetic peptide
  Seed: AGREEYSAM (NRAS Q61R)
ARREEYSAY

SEQ ID NO: 14387 - protein, 9 aa, Artificial Sequence
  Description of Artificial Sequence: Synthetic peptide
  Seed: AGREEYSAM (NRAS Q61R)
ASREEYSAL

SEQ ID NO: 14388 - protein, 9 aa, Artificial Sequence
  Description of Artificial Sequence: Synthetic peptide
  Seed: AGREEYSAM (NRAS Q61R)
ASREEYSAM

SEQ ID NO: 14389 - protein, 10 aa, Artificial Sequence
  Description of Artificial Sequence: Synthetic peptide
  Seed: AGREEYSAMR (NRAS Q61R)
ASREEYSAMR

SEQ ID NO: 14390 - protein, 9 aa, Artificial Sequence
  Description of Artificial Sequence: Synthetic peptide
  Seed: AGREEYSAM (NRAS Q61R)
ASREEYSAY

SEQ ID NO: 14391 - protein, 9 aa, Artificial Sequence
  Description of Artificial Sequence: Synthetic peptide
  Seed: AGREEYSAM (NRAS Q61R)
ATREEYSAF

SEQ ID NO: 14392 - protein, 9 aa, Artificial Sequence
  Description of Artificial Sequence: Synthetic peptide
  Seed: AGREEYSAM (NRAS Q61R)
ATREEYSAM

SEQ ID NO: 14393 - protein, 10 aa, Artificial Sequence
  Description of Artificial Sequence: Synthetic peptide
  Seed: AGREEYSAMR (NRAS Q61R)
ATREEYSAMK

SEQ ID NO: 14394 - protein, 9 aa, Artificial Sequence
  Description of Artificial Sequence: Synthetic peptide
  Seed: AGREEYSAM (NRAS Q61R)
ATREEYSAY

SEQ ID NO: 14395 - protein, 9 aa, Artificial Sequence
  Description of Artificial Sequence: Synthetic peptide
  Seed: AGREEYSAM (NRAS Q61R)
AVREEYSAM

SEQ ID NO: 14396 - protein, 10 aa, Artificial Sequence
  Description of Artificial Sequence: Synthetic peptide
  Seed: AGREEYSAMR (NRAS Q61R)
AVREEYSAMR

SEQ ID NO: 14397 - protein, 9 aa, Artificial Sequence
  Description of Artificial Sequence: Synthetic peptide
  Seed: AGREEYSAM (NRAS Q61R)
AWREEYSAF

SEQ ID NO: 14398 - protein, 10 aa, Artificial Sequence
  Description of Artificial Sequence: Synthetic peptide
  Seed: AGREEYSAMR (NRAS Q61R)
AWREEYSAMK

SEQ ID NO: 14399 - protein, 10 aa, Artificial Sequence
  Description of Artificial Sequence: Synthetic peptide
  Seed: AGREEYSAMR (NRAS Q61R)
AWREEYSAMR

SEQ ID NO: 14400 - protein, 9 aa, Artificial Sequence
  Description of Artificial Sequence: Synthetic peptide
  Seed: AGREEYSAM (NRAS Q61R)
AYREEYSAF

SEQ ID NO: 14401 - protein, 9 aa, Artificial Sequence
  Description of Artificial Sequence: Synthetic peptide
  Seed: AGREEYSAM (NRAS Q61R)
AYREEYSAM

SEQ ID NO: 14402 - protein, 10 aa, Artificial Sequence
  Description of Artificial Sequence: Synthetic peptide
  Seed: AGREEYSAMR (NRAS Q61R)
AYREEYSAMK

SEQ ID NO: 14403 - protein, 9 aa, Artificial Sequence
  Description of Artificial Sequence: Synthetic peptide
  Seed: AGREEYSAM (NRAS Q61R)
AYREEYSAY

SEQ ID NO: 14404 - protein, 10 aa, Artificial Sequence
  Description of Artificial Sequence: Synthetic peptide
  Seed: ILDTAGREEY (NRAS Q61R)
IADTAGREEY

SEQ ID NO: 14405 - protein, 10 aa, Artificial Sequence
  Description of Artificial Sequence: Synthetic peptide
  Seed: ILDTAGREEY (NRAS Q61R)
IFDTAGREEY

SEQ ID NO: 14406 - protein, 10 aa, Artificial Sequence
  Description of Artificial Sequence: Synthetic peptide
  Seed: ILDTAGREEY (NRAS Q61R)
IIDTAGREEY

SEQ ID NO: 14407 - protein, 10 aa, Artificial Sequence
  Description of Artificial Sequence: Synthetic peptide
  Seed: ILDTAGREEY (NRAS Q61R)
IMDTAGREEF

SEQ ID NO: 14408 - protein, 10 aa, Artificial Sequence
  Description of Artificial Sequence: Synthetic peptide
  Seed: ILDTAGREEY (NRAS Q61R)
IMDTAGREEY

SEQ ID NO: 14409 - protein, 10 aa, Artificial Sequence
  Description of Artificial Sequence: Synthetic peptide
  Seed: ILDTAGREEY (NRAS Q61R)
IQDTAGREEY

SEQ ID NO: 14410 - protein, 10 aa, Artificial Sequence
  Description of Artificial Sequence: Synthetic peptide
  Seed: ILDTAGREEY (NRAS Q61R)
IVDTAGREEY

SEQ ID NO: 14411 - protein, 9 aa, Artificial Sequence
  Description of Artificial Sequence: Synthetic peptide
  Seed: AGREEYSAM (NRAS Q61R)
AAREEYSAA

SEQ ID NO: 14412 - protein, 9 aa, Artificial Sequence
  Description of Artificial Sequence: Synthetic peptide
  Seed: AGREEYSAM (NRAS Q61R)
AAREEYSAC

SEQ ID NO: 14413 - protein, 9 aa, Artificial Sequence
  Description of Artificial Sequence: Synthetic peptide
  Seed: AGREEYSAM (NRAS Q61R)
AAREEYSAH

SEQ ID NO: 14414 - protein, 9 aa, Artificial Sequence
  Description of Artificial Sequence: Synthetic peptide
  Seed: AGREEYSAM (NRAS Q61R)
AAREEYSAI

SEQ ID NO: 14415 - protein, 9 aa, Artificial Sequence
  Description of Artificial Sequence: Synthetic peptide
  Seed: AGREEYSAM (NRAS Q61R)
AAREEYSAK

SEQ ID NO: 14416 - protein, 9 aa, Artificial Sequence
  Description of Artificial Sequence: Synthetic peptide
  Seed: AGREEYSAM (NRAS Q61R)
AAREEYSAP

SEQ ID NO: 14417 - protein, 9 aa, Artificial Sequence
  Description of Artificial Sequence: Synthetic peptide
  Seed: AGREEYSAM (NRAS Q61R)
AAREEYSAQ

SEQ ID NO: 14418 - protein, 9 aa, Artificial Sequence
  Description of Artificial Sequence: Synthetic peptide
  Seed: AGREEYSAM (NRAS Q61R)
AAREEYSAR

SEQ ID NO: 14419 - protein, 9 aa, Artificial Sequence
  Description of Artificial Sequence: Synthetic peptide
  Seed: AGREEYSAM (NRAS Q61R)
AAREEYSAS

SEQ ID NO: 14420 - protein, 9 aa, Artificial Sequence
  Description of Artificial Sequence: Synthetic peptide
  Seed: AGREEYSAM (NRAS Q61R)
AAREEYSAT

SEQ ID NO: 14421 - protein, 9 aa, Artificial Sequence
  Description of Artificial Sequence: Synthetic peptide
  Seed: AGREEYSAM (NRAS Q61R)
AAREEYSAV

SEQ ID NO: 14422 - protein, 9 aa, Artificial Sequence
  Description of Artificial Sequence: Synthetic peptide
  Seed: AGREEYSAM (NRAS Q61R)
AAREEYSAW

SEQ ID NO: 14423 - protein, 9 aa, Artificial Sequence
  Description of Artificial Sequence: Synthetic peptide
  Seed: AGREEYSAM (NRAS Q61R)
ACREEYSAH

SEQ ID NO: 14424 - protein, 9 aa, Artificial Sequence
  Description of Artificial Sequence: Synthetic peptide
  Seed: AGREEYSAM (NRAS Q61R)
ACREEYSAL

SEQ ID NO: 14425 - protein, 9 aa, Artificial Sequence
  Description of Artificial Sequence: Synthetic peptide
  Seed: AGREEYSAM (NRAS Q61R)
ACREEYSAM

SEQ ID NO: 14426 - protein, 9 aa, Artificial Sequence
  Description of Artificial Sequence: Synthetic peptide
  Seed: AGREEYSAM (NRAS Q61R)
ADREEYSAF

SEQ ID NO: 14427 - protein, 9 aa, Artificial Sequence
  Description of Artificial Sequence: Synthetic peptide
  Seed: AGREEYSAM (NRAS Q61R)
ADREEYSAI

SEQ ID NO: 14428 - protein, 9 aa, Artificial Sequence
  Description of Artificial Sequence: Synthetic peptide
  Seed: AGREEYSAM (NRAS Q61R)
ADREEYSAL

SEQ ID NO: 14429 - protein, 9 aa, Artificial Sequence
  Description of Artificial Sequence: Synthetic peptide
  Seed: AGREEYSAM (NRAS Q61R)
ADREEYSAM

SEQ ID NO: 14430 - protein, 9 aa, Artificial Sequence
  Description of Artificial Sequence: Synthetic peptide
  Seed: AGREEYSAM (NRAS Q61R)
ADREEYSAY

SEQ ID NO: 14431 - protein, 9 aa, Artificial Sequence
  Description of Artificial Sequence: Synthetic peptide
  Seed: AGREEYSAM (NRAS Q61R)
AEREEYSAH

SEQ ID NO: 14432 - protein, 9 aa, Artificial Sequence
  Description of Artificial Sequence: Synthetic peptide
  Seed: AGREEYSAM (NRAS Q61R)
AEREEYSAI

SEQ ID NO: 14433 - protein, 9 aa, Artificial Sequence
  Description of Artificial Sequence: Synthetic peptide
  Seed: AGREEYSAM (NRAS Q61R)
AEREEYSAV

SEQ ID NO: 14434 - protein, 9 aa, Artificial Sequence
  Description of Artificial Sequence: Synthetic peptide
  Seed: AGREEYSAM (NRAS Q61R)
AEREEYSAW

SEQ ID NO: 14435 - protein, 9 aa, Artificial Sequence
  Description of Artificial Sequence: Synthetic peptide
  Seed: AGREEYSAM (NRAS Q61R)
AFREEYSAI

SEQ ID NO: 14436 - protein, 9 aa, Artificial Sequence
  Description of Artificial Sequence: Synthetic peptide
  Seed: AGREEYSAM (NRAS Q61R)
AFREEYSAL

SEQ ID NO: 14437 - protein, 9 aa, Artificial Sequence
  Description of Artificial Sequence: Synthetic peptide
  Seed: AGREEYSAM (NRAS Q61R)
AGREEYSAH

SEQ ID NO: 14438 - protein, 9 aa, Artificial Sequence
  Description of Artificial Sequence: Synthetic peptide
  Seed: AGREEYSAM (NRAS Q61R)
AGREEYSAI

SEQ ID NO: 14439 - protein, 9 aa, Artificial Sequence
  Description of Artificial Sequence: Synthetic peptide
  Seed: AGREEYSAM (NRAS Q61R)
AGREEYSAL

SEQ ID NO: 14440 - protein, 9 aa, Artificial Sequence
  Description of Artificial Sequence: Synthetic peptide
  Seed: AGREEYSAM (NRAS Q61R)
AGREEYSAV

SEQ ID NO: 14441 - protein, 9 aa, Artificial Sequence
  Description of Artificial Sequence: Synthetic peptide
  Seed: AGREEYSAM (NRAS Q61R)
AHREEYSAV

SEQ ID NO: 14442 - protein, 9 aa, Artificial Sequence
  Description of Artificial Sequence: Synthetic peptide
  Seed: AGREEYSAM (NRAS Q61R)
AIREEYSAA

SEQ ID NO: 14443 - protein, 9 aa, Artificial Sequence
  Description of Artificial Sequence: Synthetic peptide
  Seed: AGREEYSAM (NRAS Q61R)
AIREEYSAH

SEQ ID NO: 14444 - protein, 9 aa, Artificial Sequence
  Description of Artificial Sequence: Synthetic peptide
  Seed: AGREEYSAM (NRAS Q61R)
AIREEYSAI

SEQ ID NO: 14445 - protein, 9 aa, Artificial Sequence
  Description of Artificial Sequence: Synthetic peptide
  Seed: AGREEYSAM (NRAS Q61R)
AIREEYSAL

SEQ ID NO: 14446 - protein, 9 aa, Artificial Sequence
  Description of Artificial Sequence: Synthetic peptide
  Seed: AGREEYSAM (NRAS Q61R)
AIREEYSAV

SEQ ID NO: 14447 - protein, 9 aa, Artificial Sequence
  Description of Artificial Sequence: Synthetic peptide
  Seed: AGREEYSAM (NRAS Q61R)
AIREEYSAW

SEQ ID NO: 14448 - protein, 9 aa, Artificial Sequence
  Description of Artificial Sequence: Synthetic peptide
  Seed: AGREEYSAM (NRAS Q61R)
ALREEYSAH

SEQ ID NO: 14449 - protein, 9 aa, Artificial Sequence
  Description of Artificial Sequence: Synthetic peptide
  Seed: AGREEYSAM (NRAS Q61R)
ALREEYSAI

SEQ ID NO: 14450 - protein, 9 aa, Artificial Sequence
  Description of Artificial Sequence: Synthetic peptide
  Seed: AGREEYSAM (NRAS Q61R)
ALREEYSAV

SEQ ID NO: 14451 - protein, 9 aa, Artificial Sequence
  Description of Artificial Sequence: Synthetic peptide
  Seed: AGREEYSAM (NRAS Q61R)
ANREEYSAH

SEQ ID NO: 14452 - protein, 9 aa, Artificial Sequence
  Description of Artificial Sequence: Synthetic peptide
  Seed: AGREEYSAM (NRAS Q61R)
ANREEYSAI

SEQ ID NO: 14453 - protein, 9 aa, Artificial Sequence
  Description of Artificial Sequence: Synthetic peptide
  Seed: AGREEYSAM (NRAS Q61R)
ANREEYSAL

SEQ ID NO: 14454 - protein, 9 aa, Artificial Sequence
  Description of Artificial Sequence: Synthetic peptide
  Seed: AGREEYSAM (NRAS Q61R)
ANREEYSAV

SEQ ID NO: 14455 - protein, 9 aa, Artificial Sequence
  Description of Artificial Sequence: Synthetic peptide
  Seed: AGREEYSAM (NRAS Q61R)
APREEYSAA

SEQ ID NO: 14456 - protein, 9 aa, Artificial Sequence
  Description of Artificial Sequence: Synthetic peptide
  Seed: AGREEYSAM (NRAS Q61R)
APREEYSAC

SEQ ID NO: 14457 - protein, 9 aa, Artificial Sequence
  Description of Artificial Sequence: Synthetic peptide
  Seed: AGREEYSAM (NRAS Q61R)
APREEYSAG

SEQ ID NO: 14458 - protein, 9 aa, Artificial Sequence
  Description of Artificial Sequence: Synthetic peptide
  Seed: AGREEYSAM (NRAS Q61R)
APREEYSAH

SEQ ID NO: 14459 - protein, 9 aa, Artificial Sequence
  Description of Artificial Sequence: Synthetic peptide
  Seed: AGREEYSAM (NRAS Q61R)
APREEYSAI

SEQ ID NO: 14460 - protein, 9 aa, Artificial Sequence
  Description of Artificial Sequence: Synthetic peptide
  Seed: AGREEYSAM (NRAS Q61R)
APREEYSAK

SEQ ID NO: 14461 - protein, 9 aa, Artificial Sequence
  Description of Artificial Sequence: Synthetic peptide
  Seed: AGREEYSAM (NRAS Q61R)
APREEYSAL

SEQ ID NO: 14462 - protein, 9 aa, Artificial Sequence
  Description of Artificial Sequence: Synthetic peptide
  Seed: AGREEYSAM (NRAS Q61R)
APREEYSAM

SEQ ID NO: 14463 - protein, 9 aa, Artificial Sequence
  Description of Artificial Sequence: Synthetic peptide
  Seed: AGREEYSAM (NRAS Q61R)
APREEYSAP

SEQ ID NO: 14464 - protein, 9 aa, Artificial Sequence
  Description of Artificial Sequence: Synthetic peptide
  Seed: AGREEYSAM (NRAS Q61R)
APREEYSAQ

SEQ ID NO: 14465 - protein, 9 aa, Artificial Sequence
  Description of Artificial Sequence: Synthetic peptide
  Seed: AGREEYSAM (NRAS Q61R)
APREEYSAR

SEQ ID NO: 14466 - protein, 9 aa, Artificial Sequence
  Description of Artificial Sequence: Synthetic peptide
  Seed: AGREEYSAM (NRAS Q61R)
APREEYSAS

SEQ ID NO: 14467 - protein, 9 aa, Artificial Sequence
  Description of Artificial Sequence: Synthetic peptide
  Seed: AGREEYSAM (NRAS Q61R)
APREEYSAT

SEQ ID NO: 14468 - protein, 9 aa, Artificial Sequence
  Description of Artificial Sequence: Synthetic peptide
  Seed: AGREEYSAM (NRAS Q61R)
APREEYSAV

SEQ ID NO: 14469 - protein, 9 aa, Artificial Sequence
  Description of Artificial Sequence: Synthetic peptide
  Seed: AGREEYSAM (NRAS Q61R)
APREEYSAW

SEQ ID NO: 14470 - protein, 9 aa, Artificial Sequence
  Description of Artificial Sequence: Synthetic peptide
  Seed: AGREEYSAM (NRAS Q61R)
AQREEYSAR

SEQ ID NO: 14471 - protein, 9 aa, Artificial Sequence
  Description of Artificial Sequence: Synthetic peptide
  Seed: AGREEYSAM (NRAS Q61R)
ARREEYSAA

SEQ ID NO: 14472 - protein, 9 aa, Artificial Sequence
  Description of Artificial Sequence: Synthetic peptide
  Seed: AGREEYSAM (NRAS Q61R)
ARREEYSAC

SEQ ID NO: 14473 - protein, 9 aa, Artificial Sequence
  Description of Artificial Sequence: Synthetic peptide
  Seed: AGREEYSAM (NRAS Q61R)
ARREEYSAH

SEQ ID NO: 14474 - protein, 9 aa, Artificial Sequence
  Description of Artificial Sequence: Synthetic peptide
  Seed: AGREEYSAM (NRAS Q61R)
ARREEYSAI

SEQ ID NO: 14475 - protein, 9 aa, Artificial Sequence
  Description of Artificial Sequence: Synthetic peptide
  Seed: AGREEYSAM (NRAS Q61R)
ARREEYSAK

SEQ ID NO: 14476 - protein, 9 aa, Artificial Sequence
  Description of Artificial Sequence: Synthetic peptide
  Seed: AGREEYSAM (NRAS Q61R)
ARREEYSAR

SEQ ID NO: 14477 - protein, 9 aa, Artificial Sequence
  Description of Artificial Sequence: Synthetic peptide
  Seed: AGREEYSAM (NRAS Q61R)
ARREEYSAV

SEQ ID NO: 14478 - protein, 9 aa, Artificial Sequence
  Description of Artificial Sequence: Synthetic peptide
  Seed: AGREEYSAM (NRAS Q61R)
ARREEYSAW

SEQ ID NO: 14479 - protein, 9 aa, Artificial Sequence
  Description of Artificial Sequence: Synthetic peptide
  Seed: AGREEYSAM (NRAS Q61R)
ASREEYSAA

SEQ ID NO: 14480 - protein, 9 aa, Artificial Sequence
  Description of Artificial Sequence: Synthetic peptide
  Seed: AGREEYSAM (NRAS Q61R)
ASREEYSAC

SEQ ID NO: 14481 - protein, 9 aa, Artificial Sequence
  Description of Artificial Sequence: Synthetic peptide
  Seed: AGREEYSAM (NRAS Q61R)
ASREEYSAH

SEQ ID NO: 14482 - protein, 9 aa, Artificial Sequence
  Description of Artificial Sequence: Synthetic peptide
  Seed: AGREEYSAM (NRAS Q61R)
ASREEYSAI

SEQ ID NO: 14483 - protein, 9 aa, Artificial Sequence
  Description of Artificial Sequence: Synthetic peptide
  Seed: AGREEYSAM (NRAS Q61R)
ASREEYSAV

SEQ ID NO: 14484 - protein, 9 aa, Artificial Sequence
  Description of Artificial Sequence: Synthetic peptide
  Seed: AGREEYSAM (NRAS Q61R)
ASREEYSAW

SEQ ID NO: 14485 - protein, 9 aa, Artificial Sequence
  Description of Artificial Sequence: Synthetic peptide
  Seed: AGREEYSAM (NRAS Q61R)
ATREEYSAA

SEQ ID NO: 14486 - protein, 9 aa, Artificial Sequence
  Description of Artificial Sequence: Synthetic peptide
  Seed: AGREEYSAM (NRAS Q61R)
ATREEYSAH

SEQ ID NO: 14487 - protein, 9 aa, Artificial Sequence
  Description of Artificial Sequence: Synthetic peptide
  Seed: AGREEYSAM (NRAS Q61R)
ATREEYSAI

SEQ ID NO: 14488 - protein, 9 aa, Artificial Sequence
  Description of Artificial Sequence: Synthetic peptide
  Seed: AGREEYSAM (NRAS Q61R)
ATREEYSAL

SEQ ID NO: 14489 - protein, 9 aa, Artificial Sequence
  Description of Artificial Sequence: Synthetic peptide
  Seed: AGREEYSAM (NRAS Q61R)
ATREEYSAV

SEQ ID NO: 14490 - protein, 9 aa, Artificial Sequence
  Description of Artificial Sequence: Synthetic peptide
  Seed: AGREEYSAM (NRAS Q61R)
ATREEYSAW

SEQ ID NO: 14491 - protein, 9 aa, Artificial Sequence
  Description of Artificial Sequence: Synthetic peptide
  Seed: AGREEYSAM (NRAS Q61R)
AVREEYSAA

SEQ ID NO: 14492 - protein, 9 aa, Artificial Sequence
  Description of Artificial Sequence: Synthetic peptide
  Seed: AGREEYSAM (NRAS Q61R)
AVREEYSAC

SEQ ID NO: 14493 - protein, 9 aa, Artificial Sequence
  Description of Artificial Sequence: Synthetic peptide
  Seed: AGREEYSAM (NRAS Q61R)
AVREEYSAH

SEQ ID NO: 14494 - protein, 9 aa, Artificial Sequence
  Description of Artificial Sequence: Synthetic peptide
  Seed: AGREEYSAM (NRAS Q61R)
AVREEYSAI

SEQ ID NO: 14495 - protein, 9 aa, Artificial Sequence
  Description of Artificial Sequence: Synthetic peptide
  Seed: AGREEYSAM (NRAS Q61R)
AVREEYSAL

SEQ ID NO: 14496 - protein, 9 aa, Artificial Sequence
  Description of Artificial Sequence: Synthetic peptide
  Seed: AGREEYSAM (NRAS Q61R)
AVREEYSAV

SEQ ID NO: 14497 - protein, 9 aa, Artificial Sequence
  Description of Artificial Sequence: Synthetic peptide
  Seed: AGREEYSAM (NRAS Q61R)
AVREEYSAW

SEQ ID NO: 14498 - protein, 9 aa, Artificial Sequence
  Description of Artificial Sequence: Synthetic peptide
  Seed: AGREEYSAM (NRAS Q61R)
AWREEYSAL

SEQ ID NO: 14499 - protein, 9 aa, Artificial Sequence
  Description of Artificial Sequence: Synthetic peptide
  Seed: AGREEYSAM (NRAS Q61R)
AWREEYSAM

SEQ ID NO: 14500 - protein, 9 aa, Artificial Sequence
  Description of Artificial Sequence: Synthetic peptide
  Seed: AGREEYSAM (NRAS Q61R)
AWREEYSAY

SEQ ID NO: 14501 - protein, 9 aa, Artificial Sequence
  Description of Artificial Sequence: Synthetic peptide
  Seed: AGREEYSAM (NRAS Q61R)
AYREEYSAI

SEQ ID NO: 14502 - protein, 9 aa, Artificial Sequence
  Description of Artificial Sequence: Synthetic peptide
  Seed: AGREEYSAM (NRAS Q61R)
AYREEYSAL

SEQ ID NO: 14503 - protein, 9 aa, Artificial Sequence
  Description of Artificial Sequence: Synthetic peptide
  Seed: AGREEYSAM (NRAS Q61R)
AYREEYSAV

SEQ ID NO: 14504 - protein, 11 aa, Artificial Sequence
  Description of Artificial Sequence: Synthetic peptide
  Seed: DILDTAGREEY (NRAS Q61R)
DALDTAGREEF

SEQ ID NO: 14505 - protein, 11 aa, Artificial Sequence
  Description of Artificial Sequence: Synthetic peptide
  Seed: DILDTAGREEY (NRAS Q61R)
DALDTAGREEK

SEQ ID NO: 14506 - protein, 11 aa, Artificial Sequence
  Description of Artificial Sequence: Synthetic peptide
  Seed: DILDTAGREEY (NRAS Q61R)
DALDTAGREER

SEQ ID NO: 14507 - protein, 11 aa, Artificial Sequence
  Description of Artificial Sequence: Synthetic peptide
  Seed: DILDTAGREEY (NRAS Q61R)
DALDTAGREEW

SEQ ID NO: 14508 - protein, 11 aa, Artificial Sequence
  Description of Artificial Sequence: Synthetic peptide
  Seed: DILDTAGREEY (NRAS Q61R)
DALDTAGREEY

SEQ ID NO: 14509 - protein, 11 aa, Artificial Sequence
  Description of Artificial Sequence: Synthetic peptide
  Seed: DILDTAGREEY (NRAS Q61R)
DCLDTAGREEK

SEQ ID NO: 14510 - protein, 11 aa, Artificial Sequence
  Description of Artificial Sequence: Synthetic peptide
  Seed: DILDTAGREEY (NRAS Q61R)
DCLDTAGREER

SEQ ID NO: 14511 - protein, 11 aa, Artificial Sequence
  Description of Artificial Sequence: Synthetic peptide
  Seed: DILDTAGREEY (NRAS Q61R)
DDLDTAGREER

SEQ ID NO: 14512 - protein, 11 aa, Artificial Sequence
  Description of Artificial Sequence: Synthetic peptide
  Seed: DILDTAGREEY (NRAS Q61R)
DELDTAGREEF

SEQ ID NO: 14513 - protein, 11 aa, Artificial Sequence
  Description of Artificial Sequence: Synthetic peptide
  Seed: DILDTAGREEY (NRAS Q61R)
DELDTAGREEK

SEQ ID NO: 14514 - protein, 11 aa, Artificial Sequence
  Description of Artificial Sequence: Synthetic peptide
  Seed: DILDTAGREEY (NRAS Q61R)
DELDTAGREER

SEQ ID NO: 14515 - protein, 11 aa, Artificial Sequence
  Description of Artificial Sequence: Synthetic peptide
  Seed: DILDTAGREEY (NRAS Q61R)
DELDTAGREEW

SEQ ID NO: 14516 - protein, 11 aa, Artificial Sequence
  Description of Artificial Sequence: Synthetic peptide
  Seed: DILDTAGREEY (NRAS Q61R)
DELDTAGREEY

SEQ ID NO: 14517 - protein, 11 aa, Artificial Sequence
  Description of Artificial Sequence: Synthetic peptide
  Seed: DILDTAGREEY (NRAS Q61R)
DFLDTAGREEK

SEQ ID NO: 14518 - protein, 11 aa, Artificial Sequence
  Description of Artificial Sequence: Synthetic peptide
  Seed: DILDTAGREEY (NRAS Q61R)
DFLDTAGREER

SEQ ID NO: 14519 - protein, 11 aa, Artificial Sequence
  Description of Artificial Sequence: Synthetic peptide
  Seed: DILDTAGREEY (NRAS Q61R)
DFLDTAGREEY

SEQ ID NO: 14520 - protein, 11 aa, Artificial Sequence
  Description of Artificial Sequence: Synthetic peptide
  Seed: DILDTAGREEY (NRAS Q61R)
DGLDTAGREEF

SEQ ID NO: 14521 - protein, 11 aa, Artificial Sequence
  Description of Artificial Sequence: Synthetic peptide
  Seed: DILDTAGREEY (NRAS Q61R)
DGLDTAGREEK

SEQ ID NO: 14522 - protein, 11 aa, Artificial Sequence
  Description of Artificial Sequence: Synthetic peptide
  Seed: DILDTAGREEY (NRAS Q61R)
DGLDTAGREER

SEQ ID NO: 14523 - protein, 11 aa, Artificial Sequence
  Description of Artificial Sequence: Synthetic peptide
  Seed: DILDTAGREEY (NRAS Q61R)
DGLDTAGREEY

SEQ ID NO: 14524 - protein, 11 aa, Artificial Sequence
  Description of Artificial Sequence: Synthetic peptide
  Seed: DILDTAGREEY (NRAS Q61R)
DILDTAGREEF

SEQ ID NO: 14525 - protein, 11 aa, Artificial Sequence
  Description of Artificial Sequence: Synthetic peptide
  Seed: DILDTAGREEY (NRAS Q61R)
DILDTAGREEK

SEQ ID NO: 14526 - protein, 11 aa, Artificial Sequence
  Description of Artificial Sequence: Synthetic peptide
  Seed: DILDTAGREEY (NRAS Q61R)
DILDTAGREER

SEQ ID NO: 14527 - protein, 11 aa, Artificial Sequence
  Description of Artificial Sequence: Synthetic peptide
  Seed: DILDTAGREEY (NRAS Q61R)
DILDTAGREEW

SEQ ID NO: 14528 - protein, 11 aa, Artificial Sequence
  Description of Artificial Sequence: Synthetic peptide
  Seed: DILDTAGREEY (NRAS Q61R)
DLLDTAGREEF

SEQ ID NO: 14529 - protein, 11 aa, Artificial Sequence
  Description of Artificial Sequence: Synthetic peptide
  Seed: DILDTAGREEY (NRAS Q61R)
DLLDTAGREEK

SEQ ID NO: 14530 - protein, 11 aa, Artificial Sequence
  Description of Artificial Sequence: Synthetic peptide
  Seed: DILDTAGREEY (NRAS Q61R)
DLLDTAGREER

SEQ ID NO: 14531 - protein, 11 aa, Artificial Sequence
  Description of Artificial Sequence: Synthetic peptide
  Seed: DILDTAGREEY (NRAS Q61R)
DLLDTAGREEW

SEQ ID NO: 14532 - protein, 11 aa, Artificial Sequence
  Description of Artificial Sequence: Synthetic peptide
  Seed: DILDTAGREEY (NRAS Q61R)
DLLDTAGREEY

SEQ ID NO: 14533 - protein, 11 aa, Artificial Sequence
  Description of Artificial Sequence: Synthetic peptide
  Seed: DILDTAGREEY (NRAS Q61R)
DMLDTAGREEF

SEQ ID NO: 14534 - protein, 11 aa, Artificial Sequence
  Description of Artificial Sequence: Synthetic peptide
  Seed: DILDTAGREEY (NRAS Q61R)
DMLDTAGREEK

SEQ ID NO: 14535 - protein, 11 aa, Artificial Sequence
  Description of Artificial Sequence: Synthetic peptide
  Seed: DILDTAGREEY (NRAS Q61R)
DMLDTAGREER

SEQ ID NO: 14536 - protein, 11 aa, Artificial Sequence
  Description of Artificial Sequence: Synthetic peptide
  Seed: DILDTAGREEY (NRAS Q61R)
DMLDTAGREEW

SEQ ID NO: 14537 - protein, 11 aa, Artificial Sequence
  Description of Artificial Sequence: Synthetic peptide
  Seed: DILDTAGREEY (NRAS Q61R)
DMLDTAGREEY

SEQ ID NO: 14538 - protein, 11 aa, Artificial Sequence
  Description of Artificial Sequence: Synthetic peptide
  Seed: DILDTAGREEY (NRAS Q61R)
DNLDTAGREEK

SEQ ID NO: 14539 - protein, 11 aa, Artificial Sequence
  Description of Artificial Sequence: Synthetic peptide
  Seed: DILDTAGREEY (NRAS Q61R)
DNLDTAGREER

SEQ ID NO: 14540 - protein, 11 aa, Artificial Sequence
  Description of Artificial Sequence: Synthetic peptide
  Seed: DILDTAGREEY (NRAS Q61R)
DPLDTAGREEF

SEQ ID NO: 14541 - protein, 11 aa, Artificial Sequence
  Description of Artificial Sequence: Synthetic peptide
  Seed: DILDTAGREEY (NRAS Q61R)
DPLDTAGREEL

SEQ ID NO: 14542 - protein, 11 aa, Artificial Sequence
  Description of Artificial Sequence: Synthetic peptide
  Seed: DILDTAGREEY (NRAS Q61R)
DPLDTAGREEM

SEQ ID NO: 14543 - protein, 11 aa, Artificial Sequence
  Description of Artificial Sequence: Synthetic peptide
  Seed: DILDTAGREEY (NRAS Q61R)
DPLDTAGREEW

SEQ ID NO: 14544 - protein, 11 aa, Artificial Sequence
  Description of Artificial Sequence: Synthetic peptide
  Seed: DILDTAGREEY (NRAS Q61R)
DPLDTAGREEY

SEQ ID NO: 14545 - protein, 11 aa, Artificial Sequence
  Description of Artificial Sequence: Synthetic peptide
  Seed: DILDTAGREEY (NRAS Q61R)
DQLDTAGREEF

SEQ ID NO: 14546 - protein, 11 aa, Artificial Sequence
  Description of Artificial Sequence: Synthetic peptide
  Seed: DILDTAGREEY (NRAS Q61R)
DQLDTAGREEK

SEQ ID NO: 14547 - protein, 11 aa, Artificial Sequence
  Description of Artificial Sequence: Synthetic peptide
  Seed: DILDTAGREEY (NRAS Q61R)
DQLDTAGREEL

SEQ ID NO: 14548 - protein, 11 aa, Artificial Sequence
  Description of Artificial Sequence: Synthetic peptide
  Seed: DILDTAGREEY (NRAS Q61R)
DQLDTAGREEM

SEQ ID NO: 14549 - protein, 11 aa, Artificial Sequence
  Description of Artificial Sequence: Synthetic peptide
  Seed: DILDTAGREEY (NRAS Q61R)
DQLDTAGREER

SEQ ID NO: 14550 - protein, 11 aa, Artificial Sequence
  Description of Artificial Sequence: Synthetic peptide
  Seed: DILDTAGREEY (NRAS Q61R)
DQLDTAGREEW

SEQ ID NO: 14551 - protein, 11 aa, Artificial Sequence
  Description of Artificial Sequence: Synthetic peptide
  Seed: DILDTAGREEY (NRAS Q61R)
DQLDTAGREEY

SEQ ID NO: 14552 - protein, 11 aa, Artificial Sequence
  Description of Artificial Sequence: Synthetic peptide
  Seed: DILDTAGREEY (NRAS Q61R)
DSLDTAGREEF

SEQ ID NO: 14553 - protein, 11 aa, Artificial Sequence
  Description of Artificial Sequence: Synthetic peptide
  Seed: DILDTAGREEY (NRAS Q61R)
DSLDTAGREEK

SEQ ID NO: 14554 - protein, 11 aa, Artificial Sequence
  Description of Artificial Sequence: Synthetic peptide
  Seed: DILDTAGREEY (NRAS Q61R)
DSLDTAGREER

SEQ ID NO: 14555 - protein, 11 aa, Artificial Sequence
  Description of Artificial Sequence: Synthetic peptide
  Seed: DILDTAGREEY (NRAS Q61R)
DSLDTAGREEW

SEQ ID NO: 14556 - protein, 11 aa, Artificial Sequence
  Description of Artificial Sequence: Synthetic peptide
  Seed: DILDTAGREEY (NRAS Q61R)
DSLDTAGREEY

SEQ ID NO: 14557 - protein, 11 aa, Artificial Sequence
  Description of Artificial Sequence: Synthetic peptide
  Seed: DILDTAGREEY (NRAS Q61R)
DTLDTAGREEF

SEQ ID NO: 14558 - protein, 11 aa, Artificial Sequence
  Description of Artificial Sequence: Synthetic peptide
  Seed: DILDTAGREEY (NRAS Q61R)
DTLDTAGREEH

SEQ ID NO: 14559 - protein, 11 aa, Artificial Sequence
  Description of Artificial Sequence: Synthetic peptide
  Seed: DILDTAGREEY (NRAS Q61R)
DTLDTAGREEK

SEQ ID NO: 14560 - protein, 11 aa, Artificial Sequence
  Description of Artificial Sequence: Synthetic peptide
  Seed: DILDTAGREEY (NRAS Q61R)
DTLDTAGREEL

SEQ ID NO: 14561 - protein, 11 aa, Artificial Sequence
  Description of Artificial Sequence: Synthetic peptide
  Seed: DILDTAGREEY (NRAS Q61R)
DTLDTAGREEM

SEQ ID NO: 14562 - protein, 11 aa, Artificial Sequence
  Description of Artificial Sequence: Synthetic peptide
  Seed: DILDTAGREEY (NRAS Q61R)
DTLDTAGREER

SEQ ID NO: 14563 - protein, 11 aa, Artificial Sequence
  Description of Artificial Sequence: Synthetic peptide
  Seed: DILDTAGREEY (NRAS Q61R)
DTLDTAGREEW

SEQ ID NO: 14564 - protein, 11 aa, Artificial Sequence
  Description of Artificial Sequence: Synthetic peptide
  Seed: DILDTAGREEY (NRAS Q61R)
DTLDTAGREEY

SEQ ID NO: 14565 - protein, 11 aa, Artificial Sequence
  Description of Artificial Sequence: Synthetic peptide
  Seed: DILDTAGREEY (NRAS Q61R)
DVLDTAGREEF

SEQ ID NO: 14566 - protein, 11 aa, Artificial Sequence
  Description of Artificial Sequence: Synthetic peptide
  Seed: DILDTAGREEY (NRAS Q61R)
DVLDTAGREEH

SEQ ID NO: 14567 - protein, 11 aa, Artificial Sequence
  Description of Artificial Sequence: Synthetic peptide
  Seed: DILDTAGREEY (NRAS Q61R)
DVLDTAGREEK

SEQ ID NO: 14568 - protein, 11 aa, Artificial Sequence
  Description of Artificial Sequence: Synthetic peptide
  Seed: DILDTAGREEY (NRAS Q61R)
DVLDTAGREEL

SEQ ID NO: 14569 - protein, 11 aa, Artificial Sequence
  Description of Artificial Sequence: Synthetic peptide
  Seed: DILDTAGREEY (NRAS Q61R)
DVLDTAGREEM

SEQ ID NO: 14570 - protein, 11 aa, Artificial Sequence
  Description of Artificial Sequence: Synthetic peptide
  Seed: DILDTAGREEY (NRAS Q61R)
DVLDTAGREER

SEQ ID NO: 14571 - protein, 11 aa, Artificial Sequence
  Description of Artificial Sequence: Synthetic peptide
  Seed: DILDTAGREEY (NRAS Q61R)
DVLDTAGREEY

SEQ ID NO: 14572 - protein, 11 aa, Artificial Sequence
  Description of Artificial Sequence: Synthetic peptide
  Seed: DILDTAGREEY (NRAS Q61R)
DWLDTAGREEY

SEQ ID NO: 14573 - protein, 11 aa, Artificial Sequence
  Description of Artificial Sequence: Synthetic peptide
  Seed: DILDTAGREEY (NRAS Q61R)
DYLDTAGREEY

SEQ ID NO: 14574 - protein, 10 aa, Artificial Sequence
  Description of Artificial Sequence: Synthetic peptide
  Seed: ILDTAGREEY (NRAS Q61R)
IADTAGREEA

SEQ ID NO: 14575 - protein, 10 aa, Artificial Sequence
  Description of Artificial Sequence: Synthetic peptide
  Seed: ILDTAGREEY (NRAS Q61R)
IADTAGREEC

SEQ ID NO: 14576 - protein, 10 aa, Artificial Sequence
  Description of Artificial Sequence: Synthetic peptide
  Seed: ILDTAGREEY (NRAS Q61R)
IADTAGREEF

SEQ ID NO: 14577 - protein, 10 aa, Artificial Sequence
  Description of Artificial Sequence: Synthetic peptide
  Seed: ILDTAGREEY (NRAS Q61R)
IADTAGREEH

SEQ ID NO: 14578 - protein, 10 aa, Artificial Sequence
  Description of Artificial Sequence: Synthetic peptide
  Seed: ILDTAGREEY (NRAS Q61R)
IADTAGREEI

SEQ ID NO: 14579 - protein, 10 aa, Artificial Sequence
  Description of Artificial Sequence: Synthetic peptide
  Seed: ILDTAGREEY (NRAS Q61R)
IADTAGREEK

SEQ ID NO: 14580 - protein, 10 aa, Artificial Sequence
  Description of Artificial Sequence: Synthetic peptide
  Seed: ILDTAGREEY (NRAS Q61R)
IADTAGREEL

SEQ ID NO: 14581 - protein, 10 aa, Artificial Sequence
  Description of Artificial Sequence: Synthetic peptide
  Seed: ILDTAGREEY (NRAS Q61R)
IADTAGREEM

SEQ ID NO: 14582 - protein, 10 aa, Artificial Sequence
  Description of Artificial Sequence: Synthetic peptide
  Seed: ILDTAGREEY (NRAS Q61R)
IADTAGREER

SEQ ID NO: 14583 - protein, 10 aa, Artificial Sequence
  Description of Artificial Sequence: Synthetic peptide
  Seed: ILDTAGREEY (NRAS Q61R)
IADTAGREET

SEQ ID NO: 14584 - protein, 10 aa, Artificial Sequence
  Description of Artificial Sequence: Synthetic peptide
  Seed: ILDTAGREEY (NRAS Q61R)
IADTAGREEV

SEQ ID NO: 14585 - protein, 10 aa, Artificial Sequence
  Description of Artificial Sequence: Synthetic peptide
  Seed: ILDTAGREEY (NRAS Q61R)
IADTAGREEW

SEQ ID NO: 14586 - protein, 10 aa, Artificial Sequence
  Description of Artificial Sequence: Synthetic peptide
  Seed: ILDTAGREEY (NRAS Q61R)
ICDTAGREEF

SEQ ID NO: 14587 - protein, 10 aa, Artificial Sequence
  Description of Artificial Sequence: Synthetic peptide
  Seed: ILDTAGREEY (NRAS Q61R)
ICDTAGREEI

SEQ ID NO: 14588 - protein, 10 aa, Artificial Sequence
  Description of Artificial Sequence: Synthetic peptide
  Seed: ILDTAGREEY (NRAS Q61R)
ICDTAGREEK

SEQ ID NO: 14589 - protein, 10 aa, Artificial Sequence
  Description of Artificial Sequence: Synthetic peptide
  Seed: ILDTAGREEY (NRAS Q61R)
ICDTAGREEL

SEQ ID NO: 14590 - protein, 10 aa, Artificial Sequence
  Description of Artificial Sequence: Synthetic peptide
  Seed: ILDTAGREEY (NRAS Q61R)
ICDTAGREEM

SEQ ID NO: 14591 - protein, 10 aa, Artificial Sequence
  Description of Artificial Sequence: Synthetic peptide
  Seed: ILDTAGREEY (NRAS Q61R)
ICDTAGREEV

SEQ ID NO: 14592 - protein, 10 aa, Artificial Sequence
  Description of Artificial Sequence: Synthetic peptide
  Seed: ILDTAGREEY (NRAS Q61R)
ICDTAGREEW

SEQ ID NO: 14593 - protein, 10 aa, Artificial Sequence
  Description of Artificial Sequence: Synthetic peptide
  Seed: ILDTAGREEY (NRAS Q61R)
ICDTAGREEY

SEQ ID NO: 14594 - protein, 10 aa, Artificial Sequence
  Description of Artificial Sequence: Synthetic peptide
  Seed: ILDTAGREEY (NRAS Q61R)
IDDTAGREEF

SEQ ID NO: 14595 - protein, 10 aa, Artificial Sequence
  Description of Artificial Sequence: Synthetic peptide
  Seed: ILDTAGREEY (NRAS Q61R)
IDDTAGREEI

SEQ ID NO: 14596 - protein, 10 aa, Artificial Sequence
  Description of Artificial Sequence: Synthetic peptide
  Seed: ILDTAGREEY (NRAS Q61R)
IDDTAGREEK

SEQ ID NO: 14597 - protein, 10 aa, Artificial Sequence
  Description of Artificial Sequence: Synthetic peptide
  Seed: ILDTAGREEY (NRAS Q61R)
IDDTAGREEL

SEQ ID NO: 14598 - protein, 10 aa, Artificial Sequence
  Description of Artificial Sequence: Synthetic peptide
  Seed: ILDTAGREEY (NRAS Q61R)
IDDTAGREEM

SEQ ID NO: 14599 - protein, 10 aa, Artificial Sequence
  Description of Artificial Sequence: Synthetic peptide
  Seed: ILDTAGREEY (NRAS Q61R)
IDDTAGREEW

SEQ ID NO: 14600 - protein, 10 aa, Artificial Sequence
  Description of Artificial Sequence: Synthetic peptide
  Seed: ILDTAGREEY (NRAS Q61R)
IDDTAGREEY

SEQ ID NO: 14601 - protein, 10 aa, Artificial Sequence
  Description of Artificial Sequence: Synthetic peptide
  Seed: ILDTAGREEY (NRAS Q61R)
IEDTAGREEF

SEQ ID NO: 14602 - protein, 10 aa, Artificial Sequence
  Description of Artificial Sequence: Synthetic peptide
  Seed: ILDTAGREEY (NRAS Q61R)
IEDTAGREEI

SEQ ID NO: 14603 - protein, 10 aa, Artificial Sequence
  Description of Artificial Sequence: Synthetic peptide
  Seed: ILDTAGREEY (NRAS Q61R)
IEDTAGREEK

SEQ ID NO: 14604 - protein, 10 aa, Artificial Sequence
  Description of Artificial Sequence: Synthetic peptide
  Seed: ILDTAGREEY (NRAS Q61R)
IEDTAGREEL

SEQ ID NO: 14605 - protein, 10 aa, Artificial Sequence
  Description of Artificial Sequence: Synthetic peptide
  Seed: ILDTAGREEY (NRAS Q61R)
IEDTAGREEM

SEQ ID NO: 14606 - protein, 10 aa, Artificial Sequence
  Description of Artificial Sequence: Synthetic peptide
  Seed: ILDTAGREEY (NRAS Q61R)
IEDTAGREEW

SEQ ID NO: 14607 - protein, 10 aa, Artificial Sequence
  Description of Artificial Sequence: Synthetic peptide
  Seed: ILDTAGREEY (NRAS Q61R)
IEDTAGREEY

SEQ ID NO: 14608 - protein, 10 aa, Artificial Sequence
  Description of Artificial Sequence: Synthetic peptide
  Seed: ILDTAGREEY (NRAS Q61R)
IFDTAGREEA

SEQ ID NO: 14609 - protein, 10 aa, Artificial Sequence
  Description of Artificial Sequence: Synthetic peptide
  Seed: ILDTAGREEY (NRAS Q61R)
IFDTAGREEC

SEQ ID NO: 14610 - protein, 10 aa, Artificial Sequence
  Description of Artificial Sequence: Synthetic peptide
  Seed: ILDTAGREEY (NRAS Q61R)
IFDTAGREEF

SEQ ID NO: 14611 - protein, 10 aa, Artificial Sequence
  Description of Artificial Sequence: Synthetic peptide
  Seed: ILDTAGREEY (NRAS Q61R)
IFDTAGREEI

SEQ ID NO: 14612 - protein, 10 aa, Artificial Sequence
  Description of Artificial Sequence: Synthetic peptide
  Seed: ILDTAGREEY (NRAS Q61R)
IFDTAGREEK

SEQ ID NO: 14613 - protein, 10 aa, Artificial Sequence
  Description of Artificial Sequence: Synthetic peptide
  Seed: ILDTAGREEY (NRAS Q61R)
IFDTAGREEL

SEQ ID NO: 14614 - protein, 10 aa, Artificial Sequence
  Description of Artificial Sequence: Synthetic peptide
  Seed: ILDTAGREEY (NRAS Q61R)
IFDTAGREEM

SEQ ID NO: 14615 - protein, 10 aa, Artificial Sequence
  Description of Artificial Sequence: Synthetic peptide
  Seed: ILDTAGREEY (NRAS Q61R)
IFDTAGREER

SEQ ID NO: 14616 - protein, 10 aa, Artificial Sequence
  Description of Artificial Sequence: Synthetic peptide
  Seed: ILDTAGREEY (NRAS Q61R)
IFDTAGREET

SEQ ID NO: 14617 - protein, 10 aa, Artificial Sequence
  Description of Artificial Sequence: Synthetic peptide
  Seed: ILDTAGREEY (NRAS Q61R)
IFDTAGREEV

SEQ ID NO: 14618 - protein, 10 aa, Artificial Sequence
  Description of Artificial Sequence: Synthetic peptide
  Seed: ILDTAGREEY (NRAS Q61R)
IFDTAGREEW

SEQ ID NO: 14619 - protein, 10 aa, Artificial Sequence
  Description of Artificial Sequence: Synthetic peptide
  Seed: ILDTAGREEY (NRAS Q61R)
IGDTAGREEF

SEQ ID NO: 14620 - protein, 10 aa, Artificial Sequence
  Description of Artificial Sequence: Synthetic peptide
  Seed: ILDTAGREEY (NRAS Q61R)
IGDTAGREEI

SEQ ID NO: 14621 - protein, 10 aa, Artificial Sequence
  Description of Artificial Sequence: Synthetic peptide
  Seed: ILDTAGREEY (NRAS Q61R)
IGDTAGREEK

SEQ ID NO: 14622 - protein, 10 aa, Artificial Sequence
  Description of Artificial Sequence: Synthetic peptide
  Seed: ILDTAGREEY (NRAS Q61R)
IGDTAGREEL

SEQ ID NO: 14623 - protein, 10 aa, Artificial Sequence
  Description of Artificial Sequence: Synthetic peptide
  Seed: ILDTAGREEY (NRAS Q61R)
IGDTAGREEM

SEQ ID NO: 14624 - protein, 10 aa, Artificial Sequence
  Description of Artificial Sequence: Synthetic peptide
  Seed: ILDTAGREEY (NRAS Q61R)
IGDTAGREER

SEQ ID NO: 14625 - protein, 10 aa, Artificial Sequence
  Description of Artificial Sequence: Synthetic peptide
  Seed: ILDTAGREEY (NRAS Q61R)
IGDTAGREEV

SEQ ID NO: 14626 - protein, 10 aa, Artificial Sequence
  Description of Artificial Sequence: Synthetic peptide
  Seed: ILDTAGREEY (NRAS Q61R)
IGDTAGREEW

SEQ ID NO: 14627 - protein, 10 aa, Artificial Sequence
  Description of Artificial Sequence: Synthetic peptide
  Seed: ILDTAGREEY (NRAS Q61R)
IGDTAGREEY

SEQ ID NO: 14628 - protein, 10 aa, Artificial Sequence
  Description of Artificial Sequence: Synthetic peptide
  Seed: ILDTAGREEY (NRAS Q61R)
IHDTAGREEF

SEQ ID NO: 14629 - protein, 10 aa, Artificial Sequence
  Description of Artificial Sequence: Synthetic peptide
  Seed: ILDTAGREEY (NRAS Q61R)
IHDTAGREEI

SEQ ID NO: 14630 - protein, 10 aa, Artificial Sequence
  Description of Artificial Sequence: Synthetic peptide
  Seed: ILDTAGREEY (NRAS Q61R)
IHDTAGREEL

SEQ ID NO: 14631 - protein, 10 aa, Artificial Sequence
  Description of Artificial Sequence: Synthetic peptide
  Seed: ILDTAGREEY (NRAS Q61R)
IHDTAGREEM

SEQ ID NO: 14632 - protein, 10 aa, Artificial Sequence
  Description of Artificial Sequence: Synthetic peptide
  Seed: ILDTAGREEY (NRAS Q61R)
IHDTAGREEW

SEQ ID NO: 14633 - protein, 10 aa, Artificial Sequence
  Description of Artificial Sequence: Synthetic peptide
  Seed: ILDTAGREEY (NRAS Q61R)
IHDTAGREEY

SEQ ID NO: 14634 - protein, 10 aa, Artificial Sequence
  Description of Artificial Sequence: Synthetic peptide
  Seed: ILDTAGREEY (NRAS Q61R)
IIDTAGREEA

SEQ ID NO: 14635 - protein, 10 aa, Artificial Sequence
  Description of Artificial Sequence: Synthetic peptide
  Seed: ILDTAGREEY (NRAS Q61R)
IIDTAGREEC

SEQ ID NO: 14636 - protein, 10 aa, Artificial Sequence
  Description of Artificial Sequence: Synthetic peptide
  Seed: ILDTAGREEY (NRAS Q61R)
IIDTAGREEF

SEQ ID NO: 14637 - protein, 10 aa, Artificial Sequence
  Description of Artificial Sequence: Synthetic peptide
  Seed: ILDTAGREEY (NRAS Q61R)
IIDTAGREEH

SEQ ID NO: 14638 - protein, 10 aa, Artificial Sequence
  Description of Artificial Sequence: Synthetic peptide
  Seed: ILDTAGREEY (NRAS Q61R)
IIDTAGREEI

SEQ ID NO: 14639 - protein, 10 aa, Artificial Sequence
  Description of Artificial Sequence: Synthetic peptide
  Seed: ILDTAGREEY (NRAS Q61R)
IIDTAGREEK

SEQ ID NO: 14640 - protein, 10 aa, Artificial Sequence
  Description of Artificial Sequence: Synthetic peptide
  Seed: ILDTAGREEY (NRAS Q61R)
IIDTAGREEL

SEQ ID NO: 14641 - protein, 10 aa, Artificial Sequence
  Description of Artificial Sequence: Synthetic peptide
  Seed: ILDTAGREEY (NRAS Q61R)
IIDTAGREEM

SEQ ID NO: 14642 - protein, 10 aa, Artificial Sequence
  Description of Artificial Sequence: Synthetic peptide
  Seed: ILDTAGREEY (NRAS Q61R)
IIDTAGREER

SEQ ID NO: 14643 - protein, 10 aa, Artificial Sequence
  Description of Artificial Sequence: Synthetic peptide
  Seed: ILDTAGREEY (NRAS Q61R)
IIDTAGREEV

SEQ ID NO: 14644 - protein, 10 aa, Artificial Sequence
  Description of Artificial Sequence: Synthetic peptide
  Seed: ILDTAGREEY (NRAS Q61R)
IIDTAGREEW

SEQ ID NO: 14645 - protein, 10 aa, Artificial Sequence
  Description of Artificial Sequence: Synthetic peptide
  Seed: ILDTAGREEY (NRAS Q61R)
IKDTAGREEL

SEQ ID NO: 14646 - protein, 10 aa, Artificial Sequence
  Description of Artificial Sequence: Synthetic peptide
  Seed: ILDTAGREEY (NRAS Q61R)
IKDTAGREEW

SEQ ID NO: 14647 - protein, 10 aa, Artificial Sequence
  Description of Artificial Sequence: Synthetic peptide
  Seed: ILDTAGREEY (NRAS Q61R)
IKDTAGREEY

SEQ ID NO: 14648 - protein, 10 aa, Artificial Sequence
  Description of Artificial Sequence: Synthetic peptide
  Seed: ILDTAGREEY (NRAS Q61R)
ILDTAGREEA

SEQ ID NO: 14649 - protein, 10 aa, Artificial Sequence
  Description of Artificial Sequence: Synthetic peptide
  Seed: ILDTAGREEY (NRAS Q61R)
ILDTAGREEC

SEQ ID NO: 14650 - protein, 10 aa, Artificial Sequence
  Description of Artificial Sequence: Synthetic peptide
  Seed: ILDTAGREEY (NRAS Q61R)
ILDTAGREEF

SEQ ID NO: 14651 - protein, 10 aa, Artificial Sequence
  Description of Artificial Sequence: Synthetic peptide
  Seed: ILDTAGREEY (NRAS Q61R)
ILDTAGREEH

SEQ ID NO: 14652 - protein, 10 aa, Artificial Sequence
  Description of Artificial Sequence: Synthetic peptide
  Seed: ILDTAGREEY (NRAS Q61R)
ILDTAGREEI

SEQ ID NO: 14653 - protein, 10 aa, Artificial Sequence
  Description of Artificial Sequence: Synthetic peptide
  Seed: ILDTAGREEY (NRAS Q61R)
ILDTAGREEK

SEQ ID NO: 14654 - protein, 10 aa, Artificial Sequence
  Description of Artificial Sequence: Synthetic peptide
  Seed: ILDTAGREEY (NRAS Q61R)
ILDTAGREEL

SEQ ID NO: 14655 - protein, 10 aa, Artificial Sequence
  Description of Artificial Sequence: Synthetic peptide
  Seed: ILDTAGREEY (NRAS Q61R)
ILDTAGREEM

SEQ ID NO: 14656 - protein, 10 aa, Artificial Sequence
  Description of Artificial Sequence: Synthetic peptide
  Seed: ILDTAGREEY (NRAS Q61R)
ILDTAGREER

SEQ ID NO: 14657 - protein, 10 aa, Artificial Sequence
  Description of Artificial Sequence: Synthetic peptide
  Seed: ILDTAGREEY (NRAS Q61R)
ILDTAGREEV

SEQ ID NO: 14658 - protein, 10 aa, Artificial Sequence
  Description of Artificial Sequence: Synthetic peptide
  Seed: ILDTAGREEY (NRAS Q61R)
ILDTAGREEW

SEQ ID NO: 14659 - protein, 10 aa, Artificial Sequence
  Description of Artificial Sequence: Synthetic peptide
  Seed: ILDTAGREEY (NRAS Q61R)
IMDTAGREEA

SEQ ID NO: 14660 - protein, 10 aa, Artificial Sequence
  Description of Artificial Sequence: Synthetic peptide
  Seed: ILDTAGREEY (NRAS Q61R)
IMDTAGREEC

SEQ ID NO: 14661 - protein, 10 aa, Artificial Sequence
  Description of Artificial Sequence: Synthetic peptide
  Seed: ILDTAGREEY (NRAS Q61R)
IMDTAGREEH

SEQ ID NO: 14662 - protein, 10 aa, Artificial Sequence
  Description of Artificial Sequence: Synthetic peptide
  Seed: ILDTAGREEY (NRAS Q61R)
IMDTAGREEI

SEQ ID NO: 14663 - protein, 10 aa, Artificial Sequence
  Description of Artificial Sequence: Synthetic peptide
  Seed: ILDTAGREEY (NRAS Q61R)
IMDTAGREEK

SEQ ID NO: 14664 - protein, 10 aa, Artificial Sequence
  Description of Artificial Sequence: Synthetic peptide
  Seed: ILDTAGREEY (NRAS Q61R)
IMDTAGREEM

SEQ ID NO: 14665 - protein, 10 aa, Artificial Sequence
  Description of Artificial Sequence: Synthetic peptide
  Seed: ILDTAGREEY (NRAS Q61R)
IMDTAGREER

SEQ ID NO: 14666 - protein, 10 aa, Artificial Sequence
  Description of Artificial Sequence: Synthetic peptide
  Seed: ILDTAGREEY (NRAS Q61R)
IMDTAGREEV

SEQ ID NO: 14667 - protein, 10 aa, Artificial Sequence
  Description of Artificial Sequence: Synthetic peptide
  Seed: ILDTAGREEY (NRAS Q61R)
IMDTAGREEW

SEQ ID NO: 14668 - protein, 10 aa, Artificial Sequence
  Description of Artificial Sequence: Synthetic peptide
  Seed: ILDTAGREEY (NRAS Q61R)
INDTAGREEF

SEQ ID NO: 14669 - protein, 10 aa, Artificial Sequence
  Description of Artificial Sequence: Synthetic peptide
  Seed: ILDTAGREEY (NRAS Q61R)
INDTAGREEI

SEQ ID NO: 14670 - protein, 10 aa, Artificial Sequence
  Description of Artificial Sequence: Synthetic peptide
  Seed: ILDTAGREEY (NRAS Q61R)
INDTAGREEK

SEQ ID NO: 14671 - protein, 10 aa, Artificial Sequence
  Description of Artificial Sequence: Synthetic peptide
  Seed: ILDTAGREEY (NRAS Q61R)
INDTAGREEL

SEQ ID NO: 14672 - protein, 10 aa, Artificial Sequence
  Description of Artificial Sequence: Synthetic peptide
  Seed: ILDTAGREEY (NRAS Q61R)
INDTAGREEM

SEQ ID NO: 14673 - protein, 10 aa, Artificial Sequence
  Description of Artificial Sequence: Synthetic peptide
  Seed: ILDTAGREEY (NRAS Q61R)
INDTAGREER

SEQ ID NO: 14674 - protein, 10 aa, Artificial Sequence
  Description of Artificial Sequence: Synthetic peptide
  Seed: ILDTAGREEY (NRAS Q61R)
INDTAGREEV

SEQ ID NO: 14675 - protein, 10 aa, Artificial Sequence
  Description of Artificial Sequence: Synthetic peptide
  Seed: ILDTAGREEY (NRAS Q61R)
INDTAGREEW

SEQ ID NO: 14676 - protein, 10 aa, Artificial Sequence
  Description of Artificial Sequence: Synthetic peptide
  Seed: ILDTAGREEY (NRAS Q61R)
INDTAGREEY

SEQ ID NO: 14677 - protein, 10 aa, Artificial Sequence
  Description of Artificial Sequence: Synthetic peptide
  Seed: ILDTAGREEY (NRAS Q61R)
IPDTAGREEF

SEQ ID NO: 14678 - protein, 10 aa, Artificial Sequence
  Description of Artificial Sequence: Synthetic peptide
  Seed: ILDTAGREEY (NRAS Q61R)
IPDTAGREEH

SEQ ID NO: 14679 - protein, 10 aa, Artificial Sequence
  Description of Artificial Sequence: Synthetic peptide
  Seed: ILDTAGREEY (NRAS Q61R)
IPDTAGREEI

SEQ ID NO: 14680 - protein, 10 aa, Artificial Sequence
  Description of Artificial Sequence: Synthetic peptide
  Seed: ILDTAGREEY (NRAS Q61R)
IPDTAGREEL

SEQ ID NO: 14681 - protein, 10 aa, Artificial Sequence
  Description of Artificial Sequence: Synthetic peptide
  Seed: ILDTAGREEY (NRAS Q61R)
IPDTAGREEM

SEQ ID NO: 14682 - protein, 10 aa, Artificial Sequence
  Description of Artificial Sequence: Synthetic peptide
  Seed: ILDTAGREEY (NRAS Q61R)
IPDTAGREEV

SEQ ID NO: 14683 - protein, 10 aa, Artificial Sequence
  Description of Artificial Sequence: Synthetic peptide
  Seed: ILDTAGREEY (NRAS Q61R)
IPDTAGREEW

SEQ ID NO: 14684 - protein, 10 aa, Artificial Sequence
  Description of Artificial Sequence: Synthetic peptide
  Seed: ILDTAGREEY (NRAS Q61R)
IPDTAGREEY

SEQ ID NO: 14685 - protein, 10 aa, Artificial Sequence
  Description of Artificial Sequence: Synthetic peptide
  Seed: ILDTAGREEY (NRAS Q61R)
IQDTAGREEF

SEQ ID NO: 14686 - protein, 10 aa, Artificial Sequence
  Description of Artificial Sequence: Synthetic peptide
  Seed: ILDTAGREEY (NRAS Q61R)
IQDTAGREEI

SEQ ID NO: 14687 - protein, 10 aa, Artificial Sequence
  Description of Artificial Sequence: Synthetic peptide
  Seed: ILDTAGREEY (NRAS Q61R)
IQDTAGREEK

SEQ ID NO: 14688 - protein, 10 aa, Artificial Sequence
  Description of Artificial Sequence: Synthetic peptide
  Seed: ILDTAGREEY (NRAS Q61R)
IQDTAGREEL

SEQ ID NO: 14689 - protein, 10 aa, Artificial Sequence
  Description of Artificial Sequence: Synthetic peptide
  Seed: ILDTAGREEY (NRAS Q61R)
IQDTAGREEM

SEQ ID NO: 14690 - protein, 10 aa, Artificial Sequence
  Description of Artificial Sequence: Synthetic peptide
  Seed: ILDTAGREEY (NRAS Q61R)
IQDTAGREER

SEQ ID NO: 14691 - protein, 10 aa, Artificial Sequence
  Description of Artificial Sequence: Synthetic peptide
  Seed: ILDTAGREEY (NRAS Q61R)
IQDTAGREEV

SEQ ID NO: 14692 - protein, 10 aa, Artificial Sequence
  Description of Artificial Sequence: Synthetic peptide
  Seed: ILDTAGREEY (NRAS Q61R)
IQDTAGREEW

SEQ ID NO: 14693 - protein, 10 aa, Artificial Sequence
  Description of Artificial Sequence: Synthetic peptide
  Seed: ILDTAGREEY (NRAS Q61R)
IRDTAGREEL

SEQ ID NO: 14694 - protein, 10 aa, Artificial Sequence
  Description of Artificial Sequence: Synthetic peptide
  Seed: ILDTAGREEY (NRAS Q61R)
IRDTAGREEY

SEQ ID NO: 14695 - protein, 10 aa, Artificial Sequence
  Description of Artificial Sequence: Synthetic peptide
  Seed: ILDTAGREEY (NRAS Q61R)
ISDTAGREEA

SEQ ID NO: 14696 - protein, 10 aa, Artificial Sequence
  Description of Artificial Sequence: Synthetic peptide
  Seed: ILDTAGREEY (NRAS Q61R)
ISDTAGREEC

SEQ ID NO: 14697 - protein, 10 aa, Artificial Sequence
  Description of Artificial Sequence: Synthetic peptide
  Seed: ILDTAGREEY (NRAS Q61R)
ISDTAGREEF

SEQ ID NO: 14698 - protein, 10 aa, Artificial Sequence
  Description of Artificial Sequence: Synthetic peptide
  Seed: ILDTAGREEY (NRAS Q61R)
ISDTAGREEH

SEQ ID NO: 14699 - protein, 10 aa, Artificial Sequence
  Description of Artificial Sequence: Synthetic peptide
  Seed: ILDTAGREEY (NRAS Q61R)
ISDTAGREEI

SEQ ID NO: 14700 - protein, 10 aa, Artificial Sequence
  Description of Artificial Sequence: Synthetic peptide
  Seed: ILDTAGREEY (NRAS Q61R)
ISDTAGREEK

SEQ ID NO: 14701 - protein, 10 aa, Artificial Sequence
  Description of Artificial Sequence: Synthetic peptide
  Seed: ILDTAGREEY (NRAS Q61R)
ISDTAGREEL

SEQ ID NO: 14702 - protein, 10 aa, Artificial Sequence
  Description of Artificial Sequence: Synthetic peptide
  Seed: ILDTAGREEY (NRAS Q61R)
ISDTAGREEM

SEQ ID NO: 14703 - protein, 10 aa, Artificial Sequence
  Description of Artificial Sequence: Synthetic peptide
  Seed: ILDTAGREEY (NRAS Q61R)
ISDTAGREER

SEQ ID NO: 14704 - protein, 10 aa, Artificial Sequence
  Description of Artificial Sequence: Synthetic peptide
  Seed: ILDTAGREEY (NRAS Q61R)
ISDTAGREEV

SEQ ID NO: 14705 - protein, 10 aa, Artificial Sequence
  Description of Artificial Sequence: Synthetic peptide
  Seed: ILDTAGREEY (NRAS Q61R)
ISDTAGREEW

SEQ ID NO: 14706 - protein, 10 aa, Artificial Sequence
  Description of Artificial Sequence: Synthetic peptide
  Seed: ILDTAGREEY (NRAS Q61R)
ITDTAGREEA

SEQ ID NO: 14707 - protein, 10 aa, Artificial Sequence
  Description of Artificial Sequence: Synthetic peptide
  Seed: ILDTAGREEY (NRAS Q61R)
ITDTAGREEC

SEQ ID NO: 14708 - protein, 10 aa, Artificial Sequence
  Description of Artificial Sequence: Synthetic peptide
  Seed: ILDTAGREEY (NRAS Q61R)
ITDTAGREEF

SEQ ID NO: 14709 - protein, 10 aa, Artificial Sequence
  Description of Artificial Sequence: Synthetic peptide
  Seed: ILDTAGREEY (NRAS Q61R)
ITDTAGREEH

SEQ ID NO: 14710 - protein, 10 aa, Artificial Sequence
  Description of Artificial Sequence: Synthetic peptide
  Seed: ILDTAGREEY (NRAS Q61R)
ITDTAGREEI

SEQ ID NO: 14711 - protein, 10 aa, Artificial Sequence
  Description of Artificial Sequence: Synthetic peptide
  Seed: ILDTAGREEY (NRAS Q61R)
ITDTAGREEK

SEQ ID NO: 14712 - protein, 10 aa, Artificial Sequence
  Description of Artificial Sequence: Synthetic peptide
  Seed: ILDTAGREEY (NRAS Q61R)
ITDTAGREEL

SEQ ID NO: 14713 - protein, 10 aa, Artificial Sequence
  Description of Artificial Sequence: Synthetic peptide
  Seed: ILDTAGREEY (NRAS Q61R)
ITDTAGREEM

SEQ ID NO: 14714 - protein, 10 aa, Artificial Sequence
  Description of Artificial Sequence: Synthetic peptide
  Seed: ILDTAGREEY (NRAS Q61R)
ITDTAGREEQ

SEQ ID NO: 14715 - protein, 10 aa, Artificial Sequence
  Description of Artificial Sequence: Synthetic peptide
  Seed: ILDTAGREEY (NRAS Q61R)
ITDTAGREER

SEQ ID NO: 14716 - protein, 10 aa, Artificial Sequence
  Description of Artificial Sequence: Synthetic peptide
  Seed: ILDTAGREEY (NRAS Q61R)
ITDTAGREEV

SEQ ID NO: 14717 - protein, 10 aa, Artificial Sequence
  Description of Artificial Sequence: Synthetic peptide
  Seed: ILDTAGREEY (NRAS Q61R)
ITDTAGREEW

SEQ ID NO: 14718 - protein, 10 aa, Artificial Sequence
  Description of Artificial Sequence: Synthetic peptide
  Seed: ILDTAGREEY (NRAS Q61R)
IVDTAGREEA

SEQ ID NO: 14719 - protein, 10 aa, Artificial Sequence
  Description of Artificial Sequence: Synthetic peptide
  Seed: ILDTAGREEY (NRAS Q61R)
IVDTAGREEC

SEQ ID NO: 14720 - protein, 10 aa, Artificial Sequence
  Description of Artificial Sequence: Synthetic peptide
  Seed: ILDTAGREEY (NRAS Q61R)
IVDTAGREEF

SEQ ID NO: 14721 - protein, 10 aa, Artificial Sequence
  Description of Artificial Sequence: Synthetic peptide
  Seed: ILDTAGREEY (NRAS Q61R)
IVDTAGREEH

SEQ ID NO: 14722 - protein, 10 aa, Artificial Sequence
  Description of Artificial Sequence: Synthetic peptide
  Seed: ILDTAGREEY (NRAS Q61R)
IVDTAGREEI

SEQ ID NO: 14723 - protein, 10 aa, Artificial Sequence
  Description of Artificial Sequence: Synthetic peptide
  Seed: ILDTAGREEY (NRAS Q61R)
IVDTAGREEK

SEQ ID NO: 14724 - protein, 10 aa, Artificial Sequence
  Description of Artificial Sequence: Synthetic peptide
  Seed: ILDTAGREEY (NRAS Q61R)
IVDTAGREEL

SEQ ID NO: 14725 - protein, 10 aa, Artificial Sequence
  Description of Artificial Sequence: Synthetic peptide
  Seed: ILDTAGREEY (NRAS Q61R)
IVDTAGREEM

SEQ ID NO: 14726 - protein, 10 aa, Artificial Sequence
  Description of Artificial Sequence: Synthetic peptide
  Seed: ILDTAGREEY (NRAS Q61R)
IVDTAGREER

SEQ ID NO: 14727 - protein, 10 aa, Artificial Sequence
  Description of Artificial Sequence: Synthetic peptide
  Seed: ILDTAGREEY (NRAS Q61R)
IVDTAGREEV

SEQ ID NO: 14728 - protein, 10 aa, Artificial Sequence
  Description of Artificial Sequence: Synthetic peptide
  Seed: ILDTAGREEY (NRAS Q61R)
IVDTAGREEW

SEQ ID NO: 14729 - protein, 10 aa, Artificial Sequence
  Description of Artificial Sequence: Synthetic peptide
  Seed: ILDTAGREEY (NRAS Q61R)
IWDTAGREEA

SEQ ID NO: 14730 - protein, 10 aa, Artificial Sequence
  Description of Artificial Sequence: Synthetic peptide
  Seed: ILDTAGREEY (NRAS Q61R)
IWDTAGREEC

SEQ ID NO: 14731 - protein, 10 aa, Artificial Sequence
  Description of Artificial Sequence: Synthetic peptide
  Seed: ILDTAGREEY (NRAS Q61R)
IWDTAGREEF

SEQ ID NO: 14732 - protein, 10 aa, Artificial Sequence
  Description of Artificial Sequence: Synthetic peptide
  Seed: ILDTAGREEY (NRAS Q61R)
IWDTAGREEI

SEQ ID NO: 14733 - protein, 10 aa, Artificial Sequence
  Description of Artificial Sequence: Synthetic peptide
  Seed: ILDTAGREEY (NRAS Q61R)
IWDTAGREEK

SEQ ID NO: 14734 - protein, 10 aa, Artificial Sequence
  Description of Artificial Sequence: Synthetic peptide
  Seed: ILDTAGREEY (NRAS Q61R)
IWDTAGREEL

SEQ ID NO: 14735 - protein, 10 aa, Artificial Sequence
  Description of Artificial Sequence: Synthetic peptide
  Seed: ILDTAGREEY (NRAS Q61R)
IWDTAGREEM

SEQ ID NO: 14736 - protein, 10 aa, Artificial Sequence
  Description of Artificial Sequence: Synthetic peptide
  Seed: ILDTAGREEY (NRAS Q61R)
IWDTAGREEV

SEQ ID NO: 14737 - protein, 10 aa, Artificial Sequence
  Description of Artificial Sequence: Synthetic peptide
  Seed: ILDTAGREEY (NRAS Q61R)
IWDTAGREEW

SEQ ID NO: 14738 - protein, 10 aa, Artificial Sequence
  Description of Artificial Sequence: Synthetic peptide
  Seed: ILDTAGREEY (NRAS Q61R)
IWDTAGREEY

SEQ ID NO: 14739 - protein, 10 aa, Artificial Sequence
  Description of Artificial Sequence: Synthetic peptide
  Seed: ILDTAGREEY (NRAS Q61R)
IYDTAGREEA

SEQ ID NO: 14740 - protein, 10 aa, Artificial Sequence
  Description of Artificial Sequence: Synthetic peptide
  Seed: ILDTAGREEY (NRAS Q61R)
IYDTAGREEC

SEQ ID NO: 14741 - protein, 10 aa, Artificial Sequence
  Description of Artificial Sequence: Synthetic peptide
  Seed: ILDTAGREEY (NRAS Q61R)
IYDTAGREEF

SEQ ID NO: 14742 - protein, 10 aa, Artificial Sequence
  Description of Artificial Sequence: Synthetic peptide
  Seed: ILDTAGREEY (NRAS Q61R)
IYDTAGREEI

SEQ ID NO: 14743 - protein, 10 aa, Artificial Sequence
  Description of Artificial Sequence: Synthetic peptide
  Seed: ILDTAGREEY (NRAS Q61R)
IYDTAGREEK

SEQ ID NO: 14744 - protein, 10 aa, Artificial Sequence
  Description of Artificial Sequence: Synthetic peptide
  Seed: ILDTAGREEY (NRAS Q61R)
IYDTAGREEL

SEQ ID NO: 14745 - protein, 10 aa, Artificial Sequence
  Description of Artificial Sequence: Synthetic peptide
  Seed: ILDTAGREEY (NRAS Q61R)
IYDTAGREEM

SEQ ID NO: 14746 - protein, 10 aa, Artificial Sequence
  Description of Artificial Sequence: Synthetic peptide
  Seed: ILDTAGREEY (NRAS Q61R)
IYDTAGREER

SEQ ID NO: 14747 - protein, 10 aa, Artificial Sequence
  Description of Artificial Sequence: Synthetic peptide
  Seed: ILDTAGREEY (NRAS Q61R)
IYDTAGREET

SEQ ID NO: 14748 - protein, 10 aa, Artificial Sequence
  Description of Artificial Sequence: Synthetic peptide
  Seed: ILDTAGREEY (NRAS Q61R)
IYDTAGREEV

SEQ ID NO: 14749 - protein, 10 aa, Artificial Sequence
  Description of Artificial Sequence: Synthetic peptide
  Seed: ILDTAGREEY (NRAS Q61R)
IYDTAGREEW

SEQ ID NO: 14750 - protein, 10 aa, Artificial Sequence
  Description of Artificial Sequence: Synthetic peptide
  Seed: ILDTAGREEY (NRAS Q61R)
IYDTAGREEY

SEQ ID NO: 14751 - protein, 9 aa, Artificial Sequence
  Description of Artificial Sequence: Synthetic peptide
  Seed: LDTAGREEY (NRAS Q61R)
LATAGREEF

SEQ ID NO: 14752 - protein, 9 aa, Artificial Sequence
  Description of Artificial Sequence: Synthetic peptide
  Seed: LDTAGREEY (NRAS Q61R)
LATAGREEL

SEQ ID NO: 14753 - protein, 9 aa, Artificial Sequence
  Description of Artificial Sequence: Synthetic peptide
  Seed: LDTAGREEY (NRAS Q61R)
LATAGREEM

SEQ ID NO: 14754 - protein, 9 aa, Artificial Sequence
  Description of Artificial Sequence: Synthetic peptide
  Seed: LDTAGREEY (NRAS Q61R)
LATAGREEW

SEQ ID NO: 14755 - protein, 9 aa, Artificial Sequence
  Description of Artificial Sequence: Synthetic peptide
  Seed: LDTAGREEY (NRAS Q61R)
LATAGREEY

SEQ ID NO: 14756 - protein, 9 aa, Artificial Sequence
  Description of Artificial Sequence: Synthetic peptide
  Seed: LDTAGREEY (NRAS Q61R)
LCTAGREEF

SEQ ID NO: 14757 - protein, 9 aa, Artificial Sequence
  Description of Artificial Sequence: Synthetic peptide
  Seed: LDTAGREEY (NRAS Q61R)
LCTAGREEY

SEQ ID NO: 14758 - protein, 9 aa, Artificial Sequence
  Description of Artificial Sequence: Synthetic peptide
  Seed: LDTAGREEY (NRAS Q61R)
LDTAGREEF

SEQ ID NO: 14759 - protein, 9 aa, Artificial Sequence
  Description of Artificial Sequence: Synthetic peptide
  Seed: LDTAGREEY (NRAS Q61R)
LDTAGREEI

SEQ ID NO: 14760 - protein, 9 aa, Artificial Sequence
  Description of Artificial Sequence: Synthetic peptide
  Seed: LDTAGREEY (NRAS Q61R)
LDTAGREEL

SEQ ID NO: 14761 - protein, 9 aa, Artificial Sequence
  Description of Artificial Sequence: Synthetic peptide
  Seed: LDTAGREEY (NRAS Q61R)
LDTAGREEM

SEQ ID NO: 14762 - protein, 9 aa, Artificial Sequence
  Description of Artificial Sequence: Synthetic peptide
  Seed: LDTAGREEY (NRAS Q61R)
LDTAGREEV

SEQ ID NO: 14763 - protein, 9 aa, Artificial Sequence
  Description of Artificial Sequence: Synthetic peptide
  Seed: LDTAGREEY (NRAS Q61R)
LDTAGREEW

SEQ ID NO: 14764 - protein, 9 aa, Artificial Sequence
  Description of Artificial Sequence: Synthetic peptide
  Seed: LDTAGREEY (NRAS Q61R)
LETAGREEC

SEQ ID NO: 14765 - protein, 9 aa, Artificial Sequence
  Description of Artificial Sequence: Synthetic peptide
  Seed: LDTAGREEY (NRAS Q61R)
LETAGREEF

SEQ ID NO: 14766 - protein, 9 aa, Artificial Sequence
  Description of Artificial Sequence: Synthetic peptide
  Seed: LDTAGREEY (NRAS Q61R)
LETAGREEH

SEQ ID NO: 14767 - protein, 9 aa, Artificial Sequence
  Description of Artificial Sequence: Synthetic peptide
  Seed: LDTAGREEY (NRAS Q61R)
LETAGREEI

SEQ ID NO: 14768 - protein, 9 aa, Artificial Sequence
  Description of Artificial Sequence: Synthetic peptide
  Seed: LDTAGREEY (NRAS Q61R)
LETAGREEK

SEQ ID NO: 14769 - protein, 9 aa, Artificial Sequence
  Description of Artificial Sequence: Synthetic peptide
  Seed: LDTAGREEY (NRAS Q61R)
LETAGREEL

SEQ ID NO: 14770 - protein, 9 aa, Artificial Sequence
  Description of Artificial Sequence: Synthetic peptide
  Seed: LDTAGREEY (NRAS Q61R)
LETAGREEV

SEQ ID NO: 14771 - protein, 9 aa, Artificial Sequence
  Description of Artificial Sequence: Synthetic peptide
  Seed: LDTAGREEY (NRAS Q61R)
LETAGREEW

SEQ ID NO: 14772 - protein, 9 aa, Artificial Sequence
  Description of Artificial Sequence: Synthetic peptide
  Seed: LDTAGREEY (NRAS Q61R)
LETAGREEY

SEQ ID NO: 14773 - protein, 9 aa, Artificial Sequence
  Description of Artificial Sequence: Synthetic peptide
  Seed: LDTAGREEY (NRAS Q61R)
LFTAGREEF

SEQ ID NO: 14774 - protein, 9 aa, Artificial Sequence
  Description of Artificial Sequence: Synthetic peptide
  Seed: LDTAGREEY (NRAS Q61R)
LFTAGREEY

SEQ ID NO: 14775 - protein, 9 aa, Artificial Sequence
  Description of Artificial Sequence: Synthetic peptide
  Seed: LDTAGREEY (NRAS Q61R)
LGTAGREEF

SEQ ID NO: 14776 - protein, 9 aa, Artificial Sequence
  Description of Artificial Sequence: Synthetic peptide
  Seed: LDTAGREEY (NRAS Q61R)
LGTAGREEY

SEQ ID NO: 14777 - protein, 9 aa, Artificial Sequence
  Description of Artificial Sequence: Synthetic peptide
  Seed: LDTAGREEY (NRAS Q61R)
LHTAGREEY

SEQ ID NO: 14778 - protein, 9 aa, Artificial Sequence
  Description of Artificial Sequence: Synthetic peptide
  Seed: LDTAGREEY (NRAS Q61R)
LITAGREEF

SEQ ID NO: 14779 - protein, 9 aa, Artificial Sequence
  Description of Artificial Sequence: Synthetic peptide
  Seed: LDTAGREEY (NRAS Q61R)
LITAGREEK

SEQ ID NO: 14780 - protein, 9 aa, Artificial Sequence
  Description of Artificial Sequence: Synthetic peptide
  Seed: LDTAGREEY (NRAS Q61R)
LITAGREEL

SEQ ID NO: 14781 - protein, 9 aa, Artificial Sequence
  Description of Artificial Sequence: Synthetic peptide
  Seed: LDTAGREEY (NRAS Q61R)
LITAGREEM

SEQ ID NO: 14782 - protein, 9 aa, Artificial Sequence
  Description of Artificial Sequence: Synthetic peptide
  Seed: LDTAGREEY (NRAS Q61R)
LITAGREEY

SEQ ID NO: 14783 - protein, 9 aa, Artificial Sequence
  Description of Artificial Sequence: Synthetic peptide
  Seed: LDTAGREEY (NRAS Q61R)
LKTAGREEY

SEQ ID NO: 14784 - protein, 9 aa, Artificial Sequence
  Description of Artificial Sequence: Synthetic peptide
  Seed: LDTAGREEY (NRAS Q61R)
LLTAGREEF

SEQ ID NO: 14785 - protein, 9 aa, Artificial Sequence
  Description of Artificial Sequence: Synthetic peptide
  Seed: LDTAGREEY (NRAS Q61R)
LLTAGREEL

SEQ ID NO: 14786 - protein, 9 aa, Artificial Sequence
  Description of Artificial Sequence: Synthetic peptide
  Seed: LDTAGREEY (NRAS Q61R)
LLTAGREEM

SEQ ID NO: 14787 - protein, 9 aa, Artificial Sequence
  Description of Artificial Sequence: Synthetic peptide
  Seed: LDTAGREEY (NRAS Q61R)
LLTAGREEY

SEQ ID NO: 14788 - protein, 9 aa, Artificial Sequence
  Description of Artificial Sequence: Synthetic peptide
  Seed: LDTAGREEY (NRAS Q61R)
LMTAGREEF

SEQ ID NO: 14789 - protein, 9 aa, Artificial Sequence
  Description of Artificial Sequence: Synthetic peptide
  Seed: LDTAGREEY (NRAS Q61R)
LMTAGREEI

SEQ ID NO: 14790 - protein, 9 aa, Artificial Sequence
  Description of Artificial Sequence: Synthetic peptide
  Seed: LDTAGREEY (NRAS Q61R)
LMTAGREEL

SEQ ID NO: 14791 - protein, 9 aa, Artificial Sequence
  Description of Artificial Sequence: Synthetic peptide
  Seed: LDTAGREEY (NRAS Q61R)
LMTAGREEM

SEQ ID NO: 14792 - protein, 9 aa, Artificial Sequence
  Description of Artificial Sequence: Synthetic peptide
  Seed: LDTAGREEY (NRAS Q61R)
LMTAGREEW

SEQ ID NO: 14793 - protein, 9 aa, Artificial Sequence
  Description of Artificial Sequence: Synthetic peptide
  Seed: LDTAGREEY (NRAS Q61R)
LMTAGREEY

SEQ ID NO: 14794 - protein, 9 aa, Artificial Sequence
  Description of Artificial Sequence: Synthetic peptide
  Seed: LDTAGREEY (NRAS Q61R)
LNTAGREEF

SEQ ID NO: 14795 - protein, 9 aa, Artificial Sequence
  Description of Artificial Sequence: Synthetic peptide
  Seed: LDTAGREEY (NRAS Q61R)
LNTAGREEY

SEQ ID NO: 14796 - protein, 9 aa, Artificial Sequence
  Description of Artificial Sequence: Synthetic peptide
  Seed: LDTAGREEY (NRAS Q61R)
LPTAGREEF

SEQ ID NO: 14797 - protein, 9 aa, Artificial Sequence
  Description of Artificial Sequence: Synthetic peptide
  Seed: LDTAGREEY (NRAS Q61R)
LPTAGREEL

SEQ ID NO: 14798 - protein, 9 aa, Artificial Sequence
  Description of Artificial Sequence: Synthetic peptide
  Seed: LDTAGREEY (NRAS Q61R)
LPTAGREEM

SEQ ID NO: 14799 - protein, 9 aa, Artificial Sequence
  Description of Artificial Sequence: Synthetic peptide
  Seed: LDTAGREEY (NRAS Q61R)
LPTAGREEY

SEQ ID NO: 14800 - protein, 9 aa, Artificial Sequence
  Description of Artificial Sequence: Synthetic peptide
  Seed: LDTAGREEY (NRAS Q61R)
LQTAGREEF

SEQ ID NO: 14801 - protein, 9 aa, Artificial Sequence
  Description of Artificial Sequence: Synthetic peptide
  Seed: LDTAGREEY (NRAS Q61R)
LQTAGREEH

SEQ ID NO: 14802 - protein, 9 aa, Artificial Sequence
  Description of Artificial Sequence: Synthetic peptide
  Seed: LDTAGREEY (NRAS Q61R)
LQTAGREEI

SEQ ID NO: 14803 - protein, 9 aa, Artificial Sequence
  Description of Artificial Sequence: Synthetic peptide
  Seed: LDTAGREEY (NRAS Q61R)
LQTAGREEL

SEQ ID NO: 14804 - protein, 9 aa, Artificial Sequence
  Description of Artificial Sequence: Synthetic peptide
  Seed: LDTAGREEY (NRAS Q61R)
LQTAGREEM

SEQ ID NO: 14805 - protein, 9 aa, Artificial Sequence
  Description of Artificial Sequence: Synthetic peptide
  Seed: LDTAGREEY (NRAS Q61R)
LQTAGREEV

SEQ ID NO: 14806 - protein, 9 aa, Artificial Sequence
  Description of Artificial Sequence: Synthetic peptide
  Seed: LDTAGREEY (NRAS Q61R)
LQTAGREEW

SEQ ID NO: 14807 - protein, 9 aa, Artificial Sequence
  Description of Artificial Sequence: Synthetic peptide
  Seed: LDTAGREEY (NRAS Q61R)
LQTAGREEY

SEQ ID NO: 14808 - protein, 9 aa, Artificial Sequence
  Description of Artificial Sequence: Synthetic peptide
  Seed: LDTAGREEY (NRAS Q61R)
LRTAGREEY

SEQ ID NO: 14809 - protein, 9 aa, Artificial Sequence
  Description of Artificial Sequence: Synthetic peptide
  Seed: LDTAGREEY (NRAS Q61R)
LSTAGREEF

SEQ ID NO: 14810 - protein, 9 aa, Artificial Sequence
  Description of Artificial Sequence: Synthetic peptide
  Seed: LDTAGREEY (NRAS Q61R)
LSTAGREEK

SEQ ID NO: 14811 - protein, 9 aa, Artificial Sequence
  Description of Artificial Sequence: Synthetic peptide
  Seed: LDTAGREEY (NRAS Q61R)
LSTAGREEL

SEQ ID NO: 14812 - protein, 9 aa, Artificial Sequence
  Description of Artificial Sequence: Synthetic peptide
  Seed: LDTAGREEY (NRAS Q61R)
LSTAGREEM

SEQ ID NO: 14813 - protein, 9 aa, Artificial Sequence
  Description of Artificial Sequence: Synthetic peptide
  Seed: LDTAGREEY (NRAS Q61R)
LSTAGREEY

SEQ ID NO: 14814 - protein, 9 aa, Artificial Sequence
  Description of Artificial Sequence: Synthetic peptide
  Seed: LDTAGREEY (NRAS Q61R)
LTTAGREEF

SEQ ID NO: 14815 - protein, 9 aa, Artificial Sequence
  Description of Artificial Sequence: Synthetic peptide
  Seed: LDTAGREEY (NRAS Q61R)
LTTAGREEK

SEQ ID NO: 14816 - protein, 9 aa, Artificial Sequence
  Description of Artificial Sequence: Synthetic peptide
  Seed: LDTAGREEY (NRAS Q61R)
LTTAGREEM

SEQ ID NO: 14817 - protein, 9 aa, Artificial Sequence
  Description of Artificial Sequence: Synthetic peptide
  Seed: LDTAGREEY (NRAS Q61R)
LTTAGREEY

SEQ ID NO: 14818 - protein, 9 aa, Artificial Sequence
  Description of Artificial Sequence: Synthetic peptide
  Seed: LDTAGREEY (NRAS Q61R)
LVTAGREEF

SEQ ID NO: 14819 - protein, 9 aa, Artificial Sequence
  Description of Artificial Sequence: Synthetic peptide
  Seed: LDTAGREEY (NRAS Q61R)
LVTAGREEK

SEQ ID NO: 14820 - protein, 9 aa, Artificial Sequence
  Description of Artificial Sequence: Synthetic peptide
  Seed: LDTAGREEY (NRAS Q61R)
LVTAGREEL

SEQ ID NO: 14821 - protein, 9 aa, Artificial Sequence
  Description of Artificial Sequence: Synthetic peptide
  Seed: LDTAGREEY (NRAS Q61R)
LVTAGREEM

SEQ ID NO: 14822 - protein, 9 aa, Artificial Sequence
  Description of Artificial Sequence: Synthetic peptide
  Seed: LDTAGREEY (NRAS Q61R)
LVTAGREEY

SEQ ID NO: 14823 - protein, 9 aa, Artificial Sequence
  Description of Artificial Sequence: Synthetic peptide
  Seed: LDTAGREEY (NRAS Q61R)
LWTAGREEY

SEQ ID NO: 14824 - protein, 9 aa, Artificial Sequence
  Description of Artificial Sequence: Synthetic peptide
  Seed: LDTAGREEY (NRAS Q61R)
LYTAGREEF

SEQ ID NO: 14825 - protein, 9 aa, Artificial Sequence
  Description of Artificial Sequence: Synthetic peptide
  Seed: LDTAGREEY (NRAS Q61R)
LYTAGREEY

SEQ ID NO: 14826 - protein, 11 aa, Artificial Sequence
  Description of Artificial Sequence: Synthetic peptide
  Seed: REEYSAMRDQY (NRAS Q61R)
RDEYSAMRDQW

SEQ ID NO: 14827 - protein, 11 aa, Artificial Sequence
  Description of Artificial Sequence: Synthetic peptide
  Seed: REEYSAMRDQY (NRAS Q61R)
REEYSAMRDQF

SEQ ID NO: 14828 - protein, 11 aa, Artificial Sequence
  Description of Artificial Sequence: Synthetic peptide
  Seed: REEYSAMRDQY (NRAS Q61R)
REEYSAMRDQL

SEQ ID NO: 14829 - protein, 11 aa, Artificial Sequence
  Description of Artificial Sequence: Synthetic peptide
  Seed: REEYSAMRDQY (NRAS Q61R)
REEYSAMRDQM

SEQ ID NO: 14830 - protein, 11 aa, Artificial Sequence
  Description of Artificial Sequence: Synthetic peptide
  Seed: REEYSAMRDQY (NRAS Q61R)
RQEYSAMRDQW

SEQ ID NO: 14831 - protein, 9 aa, Homo sapiens
  Native (NRAS Q61R)
AGREEYSAM

SEQ ID NO: 14832 - protein, 10 aa, Homo sapiens
  Native (NRAS Q61R)
AGREEYSAMR

SEQ ID NO: 14833 - protein, 10 aa, Homo sapiens
  Native (NRAS Q61R)
ILDTAGREEY

SEQ ID NO: 14834 - protein, 11 aa, Homo sapiens
  Native (NRAS Q61R)
DILDTAGREEY

SEQ ID NO: 14835 - protein, 9 aa, Homo sapiens
  Native (NRAS Q61R)
LDTAGREEY

SEQ ID NO: 14836 - protein, 11 aa, Homo sapiens
  Native (NRAS Q61R)
REEYSAMRDQY

SEQ ID NO: 14837 - protein, 11 aa, Artificial Sequence
  Description of Artificial Sequence: Synthetic peptide
  Seed: KITEQEKDFLW (PIK3CA E542K)
KATEQEKDFLF

SEQ ID NO: 14838 - protein, 11 aa, Artificial Sequence
  Description of Artificial Sequence: Synthetic peptide
  Seed: KITEQEKDFLW (PIK3CA E542K)
KATEQEKDFLW

SEQ ID NO: 14839 - protein, 11 aa, Artificial Sequence
  Description of Artificial Sequence: Synthetic peptide
  Seed: KITEQEKDFLW (PIK3CA E542K)
KATEQEKDFLY

SEQ ID NO: 14840 - protein, 11 aa, Artificial Sequence
  Description of Artificial Sequence: Synthetic peptide
  Seed: KITEQEKDFLW (PIK3CA E542K)
KCTEQEKDFLW

SEQ ID NO: 14841 - protein, 11 aa, Artificial Sequence
  Description of Artificial Sequence: Synthetic peptide
  Seed: KITEQEKDFLW (PIK3CA E542K)
KFTEQEKDFLW

SEQ ID NO: 14842 - protein, 11 aa, Artificial Sequence
  Description of Artificial Sequence: Synthetic peptide
  Seed: KITEQEKDFLW (PIK3CA E542K)
KGTEQEKDFLW

SEQ ID NO: 14843 - protein, 11 aa, Artificial Sequence
  Description of Artificial Sequence: Synthetic peptide
  Seed: KITEQEKDFLW (PIK3CA E542K)
KKTEQEKDFLW

SEQ ID NO: 14844 - protein, 11 aa, Artificial Sequence
  Description of Artificial Sequence: Synthetic peptide
  Seed: KITEQEKDFLW (PIK3CA E542K)
KLTEQEKDFLW

SEQ ID NO: 14845 - protein, 11 aa, Artificial Sequence
  Description of Artificial Sequence: Synthetic peptide
  Seed: KITEQEKDFLW (PIK3CA E542K)
KMTEQEKDFLW

SEQ ID NO: 14846 - protein, 11 aa, Artificial Sequence
  Description of Artificial Sequence: Synthetic peptide
  Seed: KITEQEKDFLW (PIK3CA E542K)
KQTEQEKDFLW

SEQ ID NO: 14847 - protein, 11 aa, Artificial Sequence
  Description of Artificial Sequence: Synthetic peptide
  Seed: KITEQEKDFLW (PIK3CA E542K)
KRTEQEKDFLW

SEQ ID NO: 14848 - protein, 11 aa, Artificial Sequence
  Description of Artificial Sequence: Synthetic peptide
  Seed: KITEQEKDFLW (PIK3CA E542K)
KSTEQEKDFLF

SEQ ID NO: 14849 - protein, 11 aa, Artificial Sequence
  Description of Artificial Sequence: Synthetic peptide
  Seed: KITEQEKDFLW (PIK3CA E542K)
KSTEQEKDFLM

SEQ ID NO: 14850 - protein, 11 aa, Artificial Sequence
  Description of Artificial Sequence: Synthetic peptide
  Seed: KITEQEKDFLW (PIK3CA E542K)
KSTEQEKDFLY

SEQ ID NO: 14851 - protein, 11 aa, Artificial Sequence
  Description of Artificial Sequence: Synthetic peptide
  Seed: KITEQEKDFLW (PIK3CA E542K)
KTTEQEKDFLF

SEQ ID NO: 14852 - protein, 11 aa, Artificial Sequence
  Description of Artificial Sequence: Synthetic peptide
  Seed: KITEQEKDFLW (PIK3CA E542K)
KTTEQEKDFLY

SEQ ID NO: 14853 - protein, 11 aa, Artificial Sequence
  Description of Artificial Sequence: Synthetic peptide
  Seed: KITEQEKDFLW (PIK3CA E542K)
KVTEQEKDFLW

SEQ ID NO: 14854 - protein, 11 aa, Artificial Sequence
  Description of Artificial Sequence: Synthetic peptide
  Seed: KITEQEKDFLW (PIK3CA E542K)
KYTEQEKDFLW

SEQ ID NO: 14855 - protein, 9 aa, Artificial Sequence
  Description of Artificial Sequence: Synthetic peptide
  Seed: LSKITEQEK (PIK3CA E542K)
LMKITEQEK

SEQ ID NO: 14856 - protein, 9 aa, Artificial Sequence
  Description of Artificial Sequence: Synthetic peptide
  Seed: LSKITEQEK (PIK3CA E542K)
LTKITEQEK

SEQ ID NO: 14857 - protein, 9 aa, Artificial Sequence
  Description of Artificial Sequence: Synthetic peptide
  Seed: LSKITEQEK (PIK3CA E542K)
LVKITEQEK

SEQ ID NO: 14858 - protein, 9 aa, Artificial Sequence
  Description of Artificial Sequence: Synthetic peptide
  Seed: LSKITEQEK (PIK3CA E542K)
LYKITEQEK

SEQ ID NO: 14859 - protein, 9 aa, Artificial Sequence
  Description of Artificial Sequence: Synthetic peptide
  Seed: STRDPLSKI (PIK3CA E542K)
SARDPLSKA

SEQ ID NO: 14860 - protein, 9 aa, Artificial Sequence
  Description of Artificial Sequence: Synthetic peptide
  Seed: STRDPLSKI (PIK3CA E542K)
SARDPLSKI

SEQ ID NO: 14861 - protein, 10 aa, Artificial Sequence
  Description of Artificial Sequence: Synthetic peptide
  Seed: STRDPLSKIT (PIK3CA E542K)
SARDPLSKIA

SEQ ID NO: 14862 - protein, 10 aa, Artificial Sequence
  Description of Artificial Sequence: Synthetic peptide
  Seed: STRDPLSKIT (PIK3CA E542K)
SARDPLSKIK

SEQ ID NO: 14863 - protein, 9 aa, Artificial Sequence
  Description of Artificial Sequence: Synthetic peptide
  Seed: STRDPLSKI (PIK3CA E542K)
SARDPLSKK

SEQ ID NO: 14864 - protein, 9 aa, Artificial Sequence
  Description of Artificial Sequence: Synthetic peptide
  Seed: STRDPLSKI (PIK3CA E542K)
SARDPLSKM

SEQ ID NO: 14865 - protein, 9 aa, Artificial Sequence
  Description of Artificial Sequence: Synthetic peptide
  Seed: STRDPLSKI (PIK3CA E542K)
SARDPLSKV

SEQ ID NO: 14866 - protein, 9 aa, Artificial Sequence
  Description of Artificial Sequence: Synthetic peptide
  Seed: STRDPLSKI (PIK3CA E542K)
SARDPLSKW

SEQ ID NO: 14867 - protein, 9 aa, Artificial Sequence
  Description of Artificial Sequence: Synthetic peptide
  Seed: STRDPLSKI (PIK3CA E542K)
SARDPLSKY

SEQ ID NO: 14868 - protein, 9 aa, Artificial Sequence
  Description of Artificial Sequence: Synthetic peptide
  Seed: STRDPLSKI (PIK3CA E542K)
SCRDPLSKK

SEQ ID NO: 14869 - protein, 9 aa, Artificial Sequence
  Description of Artificial Sequence: Synthetic peptide
  Seed: STRDPLSKI (PIK3CA E542K)
SFRDPLSKA

SEQ ID NO: 14870 - protein, 10 aa, Artificial Sequence
  Description of Artificial Sequence: Synthetic peptide
  Seed: STRDPLSKIT (PIK3CA E542K)
SFRDPLSKIA

SEQ ID NO: 14871 - protein, 10 aa, Artificial Sequence
  Description of Artificial Sequence: Synthetic peptide
  Seed: STRDPLSKIT (PIK3CA E542K)
SFRDPLSKIK

SEQ ID NO: 14872 - protein, 9 aa, Artificial Sequence
  Description of Artificial Sequence: Synthetic peptide
  Seed: STRDPLSKI (PIK3CA E542K)
SFRDPLSKK

SEQ ID NO: 14873 - protein, 9 aa, Artificial Sequence
  Description of Artificial Sequence: Synthetic peptide
  Seed: STRDPLSKI (PIK3CA E542K)
SFRDPLSKV

SEQ ID NO: 14874 - protein, 9 aa, Artificial Sequence
  Description of Artificial Sequence: Synthetic peptide
  Seed: STRDPLSKI (PIK3CA E542K)
SGRDPLSKA

SEQ ID NO: 14875 - protein, 10 aa, Artificial Sequence
  Description of Artificial Sequence: Synthetic peptide
  Seed: STRDPLSKIT (PIK3CA E542K)
SGRDPLSKIK

SEQ ID NO: 14876 - protein, 9 aa, Artificial Sequence
  Description of Artificial Sequence: Synthetic peptide
  Seed: STRDPLSKI (PIK3CA E542K)
SGRDPLSKK

SEQ ID NO: 14877 - protein, 9 aa, Artificial Sequence
  Description of Artificial Sequence: Synthetic peptide
  Seed: STRDPLSKI (PIK3CA E542K)
SGRDPLSKV

SEQ ID NO: 14878 - protein, 9 aa, Artificial Sequence
  Description of Artificial Sequence: Synthetic peptide
  Seed: STRDPLSKI (PIK3CA E542K)
SGRDPLSKW

SEQ ID NO: 14879 - protein, 9 aa, Artificial Sequence
  Description of Artificial Sequence: Synthetic peptide
  Seed: STRDPLSKI (PIK3CA E542K)
SHRDPLSKK

SEQ ID NO: 14880 - protein, 9 aa, Artificial Sequence
  Description of Artificial Sequence: Synthetic peptide
  Seed: STRDPLSKI (PIK3CA E542K)
SIRDPLSKA

SEQ ID NO: 14881 - protein, 9 aa, Artificial Sequence
  Description of Artificial Sequence: Synthetic peptide
  Seed: STRDPLSKI (PIK3CA E542K)
SIRDPLSKF

SEQ ID NO: 14882 - protein, 9 aa, Artificial Sequence
  Description of Artificial Sequence: Synthetic peptide
  Seed: STRDPLSKI (PIK3CA E542K)
SIRDPLSKG

SEQ ID NO: 14883 - protein, 9 aa, Artificial Sequence
  Description of Artificial Sequence: Synthetic peptide
  Seed: STRDPLSKI (PIK3CA E542K)
SIRDPLSKI

SEQ ID NO: 14884 - protein, 10 aa, Artificial Sequence
  Description of Artificial Sequence: Synthetic peptide
  Seed: STRDPLSKIT (PIK3CA E542K)
SIRDPLSKIA

SEQ ID NO: 14885 - protein, 10 aa, Artificial Sequence
  Description of Artificial Sequence: Synthetic peptide
  Seed: STRDPLSKIT (PIK3CA E542K)
SIRDPLSKIK

SEQ ID NO: 14886 - protein, 9 aa, Artificial Sequence
  Description of Artificial Sequence: Synthetic peptide
  Seed: STRDPLSKI (PIK3CA E542K)
SIRDPLSKK

SEQ ID NO: 14887 - protein, 9 aa, Artificial Sequence
  Description of Artificial Sequence: Synthetic peptide
  Seed: STRDPLSKI (PIK3CA E542K)
SIRDPLSKL

SEQ ID NO: 14888 - protein, 9 aa, Artificial Sequence
  Description of Artificial Sequence: Synthetic peptide
  Seed: STRDPLSKI (PIK3CA E542K)
SIRDPLSKM

SEQ ID NO: 14889 - protein, 9 aa, Artificial Sequence
  Description of Artificial Sequence: Synthetic peptide
  Seed: STRDPLSKI (PIK3CA E542K)
SIRDPLSKS

SEQ ID NO: 14890 - protein, 9 aa, Artificial Sequence
  Description of Artificial Sequence: Synthetic peptide
  Seed: STRDPLSKI (PIK3CA E542K)
SIRDPLSKV

SEQ ID NO: 14891 - protein, 9 aa, Artificial Sequence
  Description of Artificial Sequence: Synthetic peptide
  Seed: STRDPLSKI (PIK3CA E542K)
SIRDPLSKW

SEQ ID NO: 14892 - protein, 9 aa, Artificial Sequence
  Description of Artificial Sequence: Synthetic peptide
  Seed: STRDPLSKI (PIK3CA E542K)
SIRDPLSKY

SEQ ID NO: 14893 - protein, 9 aa, Artificial Sequence
  Description of Artificial Sequence: Synthetic peptide
  Seed: STRDPLSKI (PIK3CA E542K)
SLRDPLSKA

SEQ ID NO: 14894 - protein, 9 aa, Artificial Sequence
  Description of Artificial Sequence: Synthetic peptide
  Seed: STRDPLSKI (PIK3CA E542K)
SLRDPLSKF

SEQ ID NO: 14895 - protein, 9 aa, Artificial Sequence
  Description of Artificial Sequence: Synthetic peptide
  Seed: STRDPLSKI (PIK3CA E542K)
SLRDPLSKI

SEQ ID NO: 14896 - protein, 10 aa, Artificial Sequence
  Description of Artificial Sequence: Synthetic peptide
  Seed: STRDPLSKIT (PIK3CA E542K)
SLRDPLSKIK

SEQ ID NO: 14897 - protein, 9 aa, Artificial Sequence
  Description of Artificial Sequence: Synthetic peptide
  Seed: STRDPLSKI (PIK3CA E542K)
SLRDPLSKK

SEQ ID NO: 14898 - protein, 9 aa, Artificial Sequence
  Description of Artificial Sequence: Synthetic peptide
  Seed: STRDPLSKI (PIK3CA E542K)
SLRDPLSKW

SEQ ID NO: 14899 - protein, 9 aa, Artificial Sequence
  Description of Artificial Sequence: Synthetic peptide
  Seed: STRDPLSKI (PIK3CA E542K)
SLRDPLSKY

SEQ ID NO: 14900 - protein, 9 aa, Artificial Sequence
  Description of Artificial Sequence: Synthetic peptide
  Seed: STRDPLSKI (PIK3CA E542K)
SMRDPLSKA

SEQ ID NO: 14901 - protein, 9 aa, Artificial Sequence
  Description of Artificial Sequence: Synthetic peptide
  Seed: STRDPLSKI (PIK3CA E542K)
SMRDPLSKF

SEQ ID NO: 14902 - protein, 9 aa, Artificial Sequence
  Description of Artificial Sequence: Synthetic peptide
  Seed: STRDPLSKI (PIK3CA E542K)
SMRDPLSKG

SEQ ID NO: 14903 - protein, 9 aa, Artificial Sequence
  Description of Artificial Sequence: Synthetic peptide
  Seed: STRDPLSKI (PIK3CA E542K)
SMRDPLSKI

SEQ ID NO: 14904 - protein, 10 aa, Artificial Sequence
  Description of Artificial Sequence: Synthetic peptide
  Seed: STRDPLSKIT (PIK3CA E542K)
SMRDPLSKIA

SEQ ID NO: 14905 - protein, 10 aa, Artificial Sequence
  Description of Artificial Sequence: Synthetic peptide
  Seed: STRDPLSKIT (PIK3CA E542K)
SMRDPLSKIK

SEQ ID NO: 14906 - protein, 9 aa, Artificial Sequence
  Description of Artificial Sequence: Synthetic peptide
  Seed: STRDPLSKI (PIK3CA E542K)
SMRDPLSKK

SEQ ID NO: 14907 - protein, 9 aa, Artificial Sequence
  Description of Artificial Sequence: Synthetic peptide
  Seed: STRDPLSKI (PIK3CA E542K)
SMRDPLSKL

SEQ ID NO: 14908 - protein, 9 aa, Artificial Sequence
  Description of Artificial Sequence: Synthetic peptide
  Seed: STRDPLSKI (PIK3CA E542K)
SMRDPLSKM

SEQ ID NO: 14909 - protein, 9 aa, Artificial Sequence
  Description of Artificial Sequence: Synthetic peptide
  Seed: STRDPLSKI (PIK3CA E542K)
SMRDPLSKR

SEQ ID NO: 14910 - protein, 9 aa, Artificial Sequence
  Description of Artificial Sequence: Synthetic peptide
  Seed: STRDPLSKI (PIK3CA E542K)
SMRDPLSKS

SEQ ID NO: 14911 - protein, 9 aa, Artificial Sequence
  Description of Artificial Sequence: Synthetic peptide
  Seed: STRDPLSKI (PIK3CA E542K)
SMRDPLSKV

SEQ ID NO: 14912 - protein, 9 aa, Artificial Sequence
  Description of Artificial Sequence: Synthetic peptide
  Seed: STRDPLSKI (PIK3CA E542K)
SMRDPLSKW

SEQ ID NO: 14913 - protein, 9 aa, Artificial Sequence
  Description of Artificial Sequence: Synthetic peptide
  Seed: STRDPLSKI (PIK3CA E542K)
SMRDPLSKY

SEQ ID NO: 14914 - protein, 10 aa, Artificial Sequence
  Description of Artificial Sequence: Synthetic peptide
  Seed: STRDPLSKIT (PIK3CA E542K)
SNRDPLSKIK

SEQ ID NO: 14915 - protein, 9 aa, Artificial Sequence
  Description of Artificial Sequence: Synthetic peptide
  Seed: STRDPLSKI (PIK3CA E542K)
SNRDPLSKK

SEQ ID NO: 14916 - protein, 9 aa, Artificial Sequence
  Description of Artificial Sequence: Synthetic peptide
  Seed: STRDPLSKI (PIK3CA E542K)
SQRDPLSKA

SEQ ID NO: 14917 - protein, 10 aa, Artificial Sequence
  Description of Artificial Sequence: Synthetic peptide
  Seed: STRDPLSKIT (PIK3CA E542K)
SQRDPLSKIK

SEQ ID NO: 14918 - protein, 9 aa, Artificial Sequence
  Description of Artificial Sequence: Synthetic peptide
  Seed: STRDPLSKI (PIK3CA E542K)
SQRDPLSKK

SEQ ID NO: 14919 - protein, 9 aa, Artificial Sequence
  Description of Artificial Sequence: Synthetic peptide
  Seed: STRDPLSKI (PIK3CA E542K)
SQRDPLSKM

SEQ ID NO: 14920 - protein, 9 aa, Artificial Sequence
  Description of Artificial Sequence: Synthetic peptide
  Seed: STRDPLSKI (PIK3CA E542K)
SQRDPLSKV

SEQ ID NO: 14921 - protein, 9 aa, Artificial Sequence
  Description of Artificial Sequence: Synthetic peptide
  Seed: STRDPLSKI (PIK3CA E542K)
SQRDPLSKW

SEQ ID NO: 14922 - protein, 9 aa, Artificial Sequence
  Description of Artificial Sequence: Synthetic peptide
  Seed: STRDPLSKI (PIK3CA E542K)
SSRDPLSKA

SEQ ID NO: 14923 - protein, 9 aa, Artificial Sequence
  Description of Artificial Sequence: Synthetic peptide
  Seed: STRDPLSKI (PIK3CA E542K)
SSRDPLSKC

SEQ ID NO: 14924 - protein, 9 aa, Artificial Sequence
  Description of Artificial Sequence: Synthetic peptide
  Seed: STRDPLSKI (PIK3CA E542K)
SSRDPLSKF

SEQ ID NO: 14925 - protein, 9 aa, Artificial Sequence
  Description of Artificial Sequence: Synthetic peptide
  Seed: STRDPLSKI (PIK3CA E542K)
SSRDPLSKG

SEQ ID NO: 14926 - protein, 9 aa, Artificial Sequence
  Description of Artificial Sequence: Synthetic peptide
  Seed: STRDPLSKI (PIK3CA E542K)
SSRDPLSKI

SEQ ID NO: 14927 - protein, 10 aa, Artificial Sequence
  Description of Artificial Sequence: Synthetic peptide
  Seed: STRDPLSKIT (PIK3CA E542K)
SSRDPLSKIA

SEQ ID NO: 14928 - protein, 10 aa, Artificial Sequence
  Description of Artificial Sequence: Synthetic peptide
  Seed: STRDPLSKIT (PIK3CA E542K)
SSRDPLSKII

SEQ ID NO: 14929 - protein, 10 aa, Artificial Sequence
  Description of Artificial Sequence: Synthetic peptide
  Seed: STRDPLSKIT (PIK3CA E542K)
SSRDPLSKIK

SEQ ID NO: 14930 - protein, 10 aa, Artificial Sequence
  Description of Artificial Sequence: Synthetic peptide
  Seed: STRDPLSKIT (PIK3CA E542K)
SSRDPLSKIL

SEQ ID NO: 14931 - protein, 10 aa, Artificial Sequence
  Description of Artificial Sequence: Synthetic peptide
  Seed: STRDPLSKIT (PIK3CA E542K)
SSRDPLSKIM

SEQ ID NO: 14932 - protein, 10 aa, Artificial Sequence
  Description of Artificial Sequence: Synthetic peptide
  Seed: STRDPLSKIT (PIK3CA E542K)
SSRDPLSKIS

SEQ ID NO: 14933 - protein, 10 aa, Artificial Sequence
  Description of Artificial Sequence: Synthetic peptide
  Seed: STRDPLSKIT (PIK3CA E542K)
SSRDPLSKIV

SEQ ID NO: 14934 - protein, 10 aa, Artificial Sequence
  Description of Artificial Sequence: Synthetic peptide
  Seed: STRDPLSKIT (PIK3CA E542K)
SSRDPLSKIY

SEQ ID NO: 14935 - protein, 9 aa, Artificial Sequence
  Description of Artificial Sequence: Synthetic peptide
  Seed: STRDPLSKI (PIK3CA E542K)
SSRDPLSKK

SEQ ID NO: 14936 - protein, 9 aa, Artificial Sequence
  Description of Artificial Sequence: Synthetic peptide
  Seed: STRDPLSKI (PIK3CA E542K)
SSRDPLSKM

SEQ ID NO: 14937 - protein, 9 aa, Artificial Sequence
  Description of Artificial Sequence: Synthetic peptide
  Seed: STRDPLSKI (PIK3CA E542K)
SSRDPLSKR

SEQ ID NO: 14938 - protein, 9 aa, Artificial Sequence
  Description of Artificial Sequence: Synthetic peptide
  Seed: STRDPLSKI (PIK3CA E542K)
SSRDPLSKS

SEQ ID NO: 14939 - protein, 9 aa, Artificial Sequence
  Description of Artificial Sequence: Synthetic peptide
  Seed: STRDPLSKI (PIK3CA E542K)
SSRDPLSKT

SEQ ID NO: 14940 - protein, 9 aa, Artificial Sequence
  Description of Artificial Sequence: Synthetic peptide
  Seed: STRDPLSKI (PIK3CA E542K)
SSRDPLSKV

SEQ ID NO: 14941 - protein, 9 aa, Artificial Sequence
  Description of Artificial Sequence: Synthetic peptide
  Seed: STRDPLSKI (PIK3CA E542K)
SSRDPLSKW

SEQ ID NO: 14942 - protein, 9 aa, Artificial Sequence
  Description of Artificial Sequence: Synthetic peptide
  Seed: STRDPLSKI (PIK3CA E542K)
STRDPLSKA

SEQ ID NO: 14943 - protein, 9 aa, Artificial Sequence
  Description of Artificial Sequence: Synthetic peptide
  Seed: STRDPLSKI (PIK3CA E542K)
STRDPLSKC

SEQ ID NO: 14944 - protein, 9 aa, Artificial Sequence
  Description of Artificial Sequence: Synthetic peptide
  Seed: STRDPLSKI (PIK3CA E542K)
STRDPLSKF

SEQ ID NO: 14945 - protein, 9 aa, Artificial Sequence
  Description of Artificial Sequence: Synthetic peptide
  Seed: STRDPLSKI (PIK3CA E542K)
STRDPLSKG

SEQ ID NO: 14946 - protein, 9 aa, Artificial Sequence
  Description of Artificial Sequence: Synthetic peptide
  Seed: STRDPLSKI (PIK3CA E542K)
STRDPLSKH

SEQ ID NO: 14947 - protein, 10 aa, Artificial Sequence
  Description of Artificial Sequence: Synthetic peptide
  Seed: STRDPLSKIT (PIK3CA E542K)
STRDPLSKIA

SEQ ID NO: 14948 - protein, 10 aa, Artificial Sequence
  Description of Artificial Sequence: Synthetic peptide
  Seed: STRDPLSKIT (PIK3CA E542K)
STRDPLSKIG

SEQ ID NO: 14949 - protein, 10 aa, Artificial Sequence
  Description of Artificial Sequence: Synthetic peptide
  Seed: STRDPLSKIT (PIK3CA E542K)
STRDPLSKII

SEQ ID NO: 14950 - protein, 10 aa, Artificial Sequence
  Description of Artificial Sequence: Synthetic peptide
  Seed: STRDPLSKIT (PIK3CA E542K)
STRDPLSKIL

SEQ ID NO: 14951 - protein, 10 aa, Artificial Sequence
  Description of Artificial Sequence: Synthetic peptide
  Seed: STRDPLSKIT (PIK3CA E542K)
STRDPLSKIM

SEQ ID NO: 14952 - protein, 10 aa, Artificial Sequence
  Description of Artificial Sequence: Synthetic peptide
  Seed: STRDPLSKIT (PIK3CA E542K)
STRDPLSKIR

SEQ ID NO: 14953 - protein, 10 aa, Artificial Sequence
  Description of Artificial Sequence: Synthetic peptide
  Seed: STRDPLSKIT (PIK3CA E542K)
STRDPLSKIS

SEQ ID NO: 14954 - protein, 10 aa, Artificial Sequence
  Description of Artificial Sequence: Synthetic peptide
  Seed: STRDPLSKIT (PIK3CA E542K)
STRDPLSKIV

SEQ ID NO: 14955 - protein, 10 aa, Artificial Sequence
  Description of Artificial Sequence: Synthetic peptide
  Seed: STRDPLSKIT (PIK3CA E542K)
STRDPLSKIY

SEQ ID NO: 14956 - protein, 9 aa, Artificial Sequence
  Description of Artificial Sequence: Synthetic peptide
  Seed: STRDPLSKI (PIK3CA E542K)
STRDPLSKK

SEQ ID NO: 14957 - protein, 9 aa, Artificial Sequence
  Description of Artificial Sequence: Synthetic peptide
  Seed: STRDPLSKI (PIK3CA E542K)
STRDPLSKL

SEQ ID NO: 14958 - protein, 9 aa, Artificial Sequence
  Description of Artificial Sequence: Synthetic peptide
  Seed: STRDPLSKI (PIK3CA E542K)
STRDPLSKM

SEQ ID NO: 14959 - protein, 9 aa, Artificial Sequence
  Description of Artificial Sequence: Synthetic peptide
  Seed: STRDPLSKI (PIK3CA E542K)
STRDPLSKN

SEQ ID NO: 14960 - protein, 9 aa, Artificial Sequence
  Description of Artificial Sequence: Synthetic peptide
  Seed: STRDPLSKI (PIK3CA E542K)
STRDPLSKP

SEQ ID NO: 14961 - protein, 9 aa, Artificial Sequence
  Description of Artificial Sequence: Synthetic peptide
  Seed: STRDPLSKI (PIK3CA E542K)
STRDPLSKQ

SEQ ID NO: 14962 - protein, 9 aa, Artificial Sequence
  Description of Artificial Sequence: Synthetic peptide
  Seed: STRDPLSKI (PIK3CA E542K)
STRDPLSKS

SEQ ID NO: 14963 - protein, 9 aa, Artificial Sequence
  Description of Artificial Sequence: Synthetic peptide
  Seed: STRDPLSKI (PIK3CA E542K)
STRDPLSKT

SEQ ID NO: 14964 - protein, 9 aa, Artificial Sequence
  Description of Artificial Sequence: Synthetic peptide
  Seed: STRDPLSKI (PIK3CA E542K)
STRDPLSKY

SEQ ID NO: 14965 - protein, 9 aa, Artificial Sequence
  Description of Artificial Sequence: Synthetic peptide
  Seed: STRDPLSKI (PIK3CA E542K)
SVRDPLSKA

SEQ ID NO: 14966 - protein, 9 aa, Artificial Sequence
  Description of Artificial Sequence: Synthetic peptide
  Seed: STRDPLSKI (PIK3CA E542K)
SVRDPLSKF

SEQ ID NO: 14967 - protein, 9 aa, Artificial Sequence
  Description of Artificial Sequence: Synthetic peptide
  Seed: STRDPLSKI (PIK3CA E542K)
SVRDPLSKG

SEQ ID NO: 14968 - protein, 9 aa, Artificial Sequence
  Description of Artificial Sequence: Synthetic peptide
  Seed: STRDPLSKI (PIK3CA E542K)
SVRDPLSKI

SEQ ID NO: 14969 - protein, 10 aa, Artificial Sequence
  Description of Artificial Sequence: Synthetic peptide
  Seed: STRDPLSKIT (PIK3CA E542K)
SVRDPLSKIA

SEQ ID NO: 14970 - protein, 10 aa, Artificial Sequence
  Description of Artificial Sequence: Synthetic peptide
  Seed: STRDPLSKIT (PIK3CA E542K)
SVRDPLSKII

SEQ ID NO: 14971 - protein, 10 aa, Artificial Sequence
  Description of Artificial Sequence: Synthetic peptide
  Seed: STRDPLSKIT (PIK3CA E542K)
SVRDPLSKIK

SEQ ID NO: 14972 - protein, 10 aa, Artificial Sequence
  Description of Artificial Sequence: Synthetic peptide
  Seed: STRDPLSKIT (PIK3CA E542K)
SVRDPLSKIL

SEQ ID NO: 14973 - protein, 10 aa, Artificial Sequence
  Description of Artificial Sequence: Synthetic peptide
  Seed: STRDPLSKIT (PIK3CA E542K)
SVRDPLSKIV

SEQ ID NO: 14974 - protein, 9 aa, Artificial Sequence
  Description of Artificial Sequence: Synthetic peptide
  Seed: STRDPLSKI (PIK3CA E542K)
SVRDPLSKL

SEQ ID NO: 14975 - protein, 9 aa, Artificial Sequence
  Description of Artificial Sequence: Synthetic peptide
  Seed: STRDPLSKI (PIK3CA E542K)
SVRDPLSKM

SEQ ID NO: 14976 - protein, 9 aa, Artificial Sequence
  Description of Artificial Sequence: Synthetic peptide
  Seed: STRDPLSKI (PIK3CA E542K)
SVRDPLSKR

SEQ ID NO: 14977 - protein, 9 aa, Artificial Sequence
  Description of Artificial Sequence: Synthetic peptide
  Seed: STRDPLSKI (PIK3CA E542K)
SVRDPLSKS

SEQ ID NO: 14978 - protein, 9 aa, Artificial Sequence
  Description of Artificial Sequence: Synthetic peptide
  Seed: STRDPLSKI (PIK3CA E542K)
SVRDPLSKT

SEQ ID NO: 14979 - protein, 9 aa, Artificial Sequence
  Description of Artificial Sequence: Synthetic peptide
  Seed: STRDPLSKI (PIK3CA E542K)
SVRDPLSKW

SEQ ID NO: 14980 - protein, 9 aa, Artificial Sequence
  Description of Artificial Sequence: Synthetic peptide
  Seed: STRDPLSKI (PIK3CA E542K)
SVRDPLSKY

SEQ ID NO: 14981 - protein, 9 aa, Artificial Sequence
  Description of Artificial Sequence: Synthetic peptide
  Seed: STRDPLSKI (PIK3CA E542K)
SWRDPLSKA

SEQ ID NO: 14982 - protein, 10 aa, Artificial Sequence
  Description of Artificial Sequence: Synthetic peptide
  Seed: STRDPLSKIT (PIK3CA E542K)
SWRDPLSKIK

SEQ ID NO: 14983 - protein, 9 aa, Artificial Sequence
  Description of Artificial Sequence: Synthetic peptide
  Seed: STRDPLSKI (PIK3CA E542K)
SWRDPLSKK

SEQ ID NO: 14984 - protein, 9 aa, Artificial Sequence
  Description of Artificial Sequence: Synthetic peptide
  Seed: STRDPLSKI (PIK3CA E542K)
SWRDPLSKV

SEQ ID NO: 14985 - protein, 9 aa, Artificial Sequence
  Description of Artificial Sequence: Synthetic peptide
  Seed: STRDPLSKI (PIK3CA E542K)
SYRDPLSKA

SEQ ID NO: 14986 - protein, 9 aa, Artificial Sequence
  Description of Artificial Sequence: Synthetic peptide
  Seed: STRDPLSKI (PIK3CA E542K)
SYRDPLSKI

SEQ ID NO: 14987 - protein, 10 aa, Artificial Sequence
  Description of Artificial Sequence: Synthetic peptide
  Seed: STRDPLSKIT (PIK3CA E542K)
SYRDPLSKIA

SEQ ID NO: 14988 - protein, 10 aa, Artificial Sequence
  Description of Artificial Sequence: Synthetic peptide
  Seed: STRDPLSKIT (PIK3CA E542K)
SYRDPLSKIK

SEQ ID NO: 14989 - protein, 9 aa, Artificial Sequence
  Description of Artificial Sequence: Synthetic peptide
  Seed: STRDPLSKI (PIK3CA E542K)
SYRDPLSKK

SEQ ID NO: 14990 - protein, 9 aa, Artificial Sequence
  Description of Artificial Sequence: Synthetic peptide
  Seed: STRDPLSKI (PIK3CA E542K)
SYRDPLSKR

SEQ ID NO: 14991 - protein, 9 aa, Artificial Sequence
  Description of Artificial Sequence: Synthetic peptide
  Seed: STRDPLSKI (PIK3CA E542K)
SYRDPLSKV

SEQ ID NO: 14992 - protein, 10 aa, Artificial Sequence
  Description of Artificial Sequence: Synthetic peptide
  Seed: ISTRDPLSKI (PIK3CA E542K)
IATRDPLSKF

SEQ ID NO: 14993 - protein, 10 aa, Artificial Sequence
  Description of Artificial Sequence: Synthetic peptide
  Seed: ISTRDPLSKI (PIK3CA E542K)
IATRDPLSKW

SEQ ID NO: 14994 - protein, 10 aa, Artificial Sequence
  Description of Artificial Sequence: Synthetic peptide
  Seed: ISTRDPLSKI (PIK3CA E542K)
ICTRDPLSKF

SEQ ID NO: 14995 - protein, 10 aa, Artificial Sequence
  Description of Artificial Sequence: Synthetic peptide
  Seed: ISTRDPLSKI (PIK3CA E542K)
ICTRDPLSKW

SEQ ID NO: 14996 - protein, 10 aa, Artificial Sequence
  Description of Artificial Sequence: Synthetic peptide
  Seed: ISTRDPLSKI (PIK3CA E542K)
IDTRDPLSKW

SEQ ID NO: 14997 - protein, 10 aa, Artificial Sequence
  Description of Artificial Sequence: Synthetic peptide
  Seed: ISTRDPLSKI (PIK3CA E542K)
IGTRDPLSKF

SEQ ID NO: 14998 - protein, 10 aa, Artificial Sequence
  Description of Artificial Sequence: Synthetic peptide
  Seed: ISTRDPLSKI (PIK3CA E542K)
IGTRDPLSKW

SEQ ID NO: 14999 - protein, 10 aa, Artificial Sequence
  Description of Artificial Sequence: Synthetic peptide
  Seed: ISTRDPLSKI (PIK3CA E542K)
IITRDPLSKF

SEQ ID NO: 15000 - protein, 10 aa, Artificial Sequence
  Description of Artificial Sequence: Synthetic peptide
  Seed: ISTRDPLSKI (PIK3CA E542K)
IITRDPLSKW

SEQ ID NO: 15001 - protein, 10 aa, Artificial Sequence
  Description of Artificial Sequence: Synthetic peptide
  Seed: ISTRDPLSKI (PIK3CA E542K)
ILTRDPLSKW

SEQ ID NO: 15002 - protein, 10 aa, Artificial Sequence
  Description of Artificial Sequence: Synthetic peptide
  Seed: ISTRDPLSKI (PIK3CA E542K)
IMTRDPLSKF

SEQ ID NO: 15003 - protein, 10 aa, Artificial Sequence
  Description of Artificial Sequence: Synthetic peptide
  Seed: ISTRDPLSKI (PIK3CA E542K)
IMTRDPLSKW

SEQ ID NO: 15004 - protein, 10 aa, Artificial Sequence
  Description of Artificial Sequence: Synthetic peptide
  Seed: ISTRDPLSKI (PIK3CA E542K)
INTRDPLSKW

SEQ ID NO: 15005 - protein, 10 aa, Artificial Sequence
  Description of Artificial Sequence: Synthetic peptide
  Seed: ISTRDPLSKI (PIK3CA E542K)
IPTRDPLSKW

SEQ ID NO: 15006 - protein, 10 aa, Artificial Sequence
  Description of Artificial Sequence: Synthetic peptide
  Seed: ISTRDPLSKI (PIK3CA E542K)
IQTRDPLSKW

SEQ ID NO: 15007 - protein, 10 aa, Artificial Sequence
  Description of Artificial Sequence: Synthetic peptide
  Seed: ISTRDPLSKI (PIK3CA E542K)
ISTRDPLSKF

SEQ ID NO: 15008 - protein, 10 aa, Artificial Sequence
  Description of Artificial Sequence: Synthetic peptide
  Seed: ISTRDPLSKI (PIK3CA E542K)
ISTRDPLSKL

SEQ ID NO: 15009 - protein, 10 aa, Artificial Sequence
  Description of Artificial Sequence: Synthetic peptide
  Seed: ISTRDPLSKI (PIK3CA E542K)
ISTRDPLSKM

SEQ ID NO: 15010 - protein, 10 aa, Artificial Sequence
  Description of Artificial Sequence: Synthetic peptide
  Seed: ISTRDPLSKI (PIK3CA E542K)
ISTRDPLSKW

SEQ ID NO: 15011 - protein, 10 aa, Artificial Sequence
  Description of Artificial Sequence: Synthetic peptide
  Seed: ISTRDPLSKI (PIK3CA E542K)
ISTRDPLSKY

SEQ ID NO: 15012 - protein, 10 aa, Artificial Sequence
  Description of Artificial Sequence: Synthetic peptide
  Seed: ISTRDPLSKI (PIK3CA E542K)
ITTRDPLSKF

SEQ ID NO: 15013 - protein, 10 aa, Artificial Sequence
  Description of Artificial Sequence: Synthetic peptide
  Seed: ISTRDPLSKI (PIK3CA E542K)
ITTRDPLSKI

SEQ ID NO: 15014 - protein, 10 aa, Artificial Sequence
  Description of Artificial Sequence: Synthetic peptide
  Seed: ISTRDPLSKI (PIK3CA E542K)
ITTRDPLSKL

SEQ ID NO: 15015 - protein, 10 aa, Artificial Sequence
  Description of Artificial Sequence: Synthetic peptide
  Seed: ISTRDPLSKI (PIK3CA E542K)
ITTRDPLSKM

SEQ ID NO: 15016 - protein, 10 aa, Artificial Sequence
  Description of Artificial Sequence: Synthetic peptide
  Seed: ISTRDPLSKI (PIK3CA E542K)
ITTRDPLSKW

SEQ ID NO: 15017 - protein, 10 aa, Artificial Sequence
  Description of Artificial Sequence: Synthetic peptide
  Seed: ISTRDPLSKI (PIK3CA E542K)
ITTRDPLSKY

SEQ ID NO: 15018 - protein, 10 aa, Artificial Sequence
  Description of Artificial Sequence: Synthetic peptide
  Seed: ISTRDPLSKI (PIK3CA E542K)
IVTRDPLSKF

SEQ ID NO: 15019 - protein, 10 aa, Artificial Sequence
  Description of Artificial Sequence: Synthetic peptide
  Seed: ISTRDPLSKI (PIK3CA E542K)
IVTRDPLSKW

SEQ ID NO: 15020 - protein, 9 aa, Artificial Sequence
  Description of Artificial Sequence: Synthetic peptide
  Seed: KITEQEKDF (PIK3CA E542K)
KATEQEKDF

SEQ ID NO: 15021 - protein, 11 aa, Artificial Sequence
  Description of Artificial Sequence: Synthetic peptide
  Seed: KITEQEKDFLW (PIK3CA E542K)
KATEQEKDFLI

SEQ ID NO: 15022 - protein, 11 aa, Artificial Sequence
  Description of Artificial Sequence: Synthetic peptide
  Seed: KITEQEKDFLW (PIK3CA E542K)
KATEQEKDFLL

SEQ ID NO: 15023 - protein, 11 aa, Artificial Sequence
  Description of Artificial Sequence: Synthetic peptide
  Seed: KITEQEKDFLW (PIK3CA E542K)
KATEQEKDFLM

SEQ ID NO: 15024 - protein, 9 aa, Artificial Sequence
  Description of Artificial Sequence: Synthetic peptide
  Seed: KITEQEKDF (PIK3CA E542K)
KATEQEKDH

SEQ ID NO: 15025 - protein, 9 aa, Artificial Sequence
  Description of Artificial Sequence: Synthetic peptide
  Seed: KITEQEKDF (PIK3CA E542K)
KATEQEKDI

SEQ ID NO: 15026 - protein, 9 aa, Artificial Sequence
  Description of Artificial Sequence: Synthetic peptide
  Seed: KITEQEKDF (PIK3CA E542K)
KATEQEKDL

SEQ ID NO: 15027 - protein, 9 aa, Artificial Sequence
  Description of Artificial Sequence: Synthetic peptide
  Seed: KITEQEKDF (PIK3CA E542K)
KATEQEKDM

SEQ ID NO: 15028 - protein, 9 aa, Artificial Sequence
  Description of Artificial Sequence: Synthetic peptide
  Seed: KITEQEKDF (PIK3CA E542K)
KATEQEKDV

SEQ ID NO: 15029 - protein, 9 aa, Artificial Sequence
  Description of Artificial Sequence: Synthetic peptide
  Seed: KITEQEKDF (PIK3CA E542K)
KATEQEKDW

SEQ ID NO: 15030 - protein, 9 aa, Artificial Sequence
  Description of Artificial Sequence: Synthetic peptide
  Seed: KITEQEKDF (PIK3CA E542K)
KATEQEKDY

SEQ ID NO: 15031 - protein, 11 aa, Artificial Sequence
  Description of Artificial Sequence: Synthetic peptide
  Seed: KITEQEKDFLW (PIK3CA E542K)
KCTEQEKDFLF

SEQ ID NO: 15032 - protein, 9 aa, Artificial Sequence
  Description of Artificial Sequence: Synthetic peptide
  Seed: KITEQEKDF (PIK3CA E542K)
KCTEQEKDW

SEQ ID NO: 15033 - protein, 11 aa, Artificial Sequence
  Description of Artificial Sequence: Synthetic peptide
  Seed: KITEQEKDFLW (PIK3CA E542K)
KDTEQEKDFLW

SEQ ID NO: 15034 - protein, 11 aa, Artificial Sequence
  Description of Artificial Sequence: Synthetic peptide
  Seed: KITEQEKDFLW (PIK3CA E542K)
KETEQEKDFLF

SEQ ID NO: 15035 - protein, 11 aa, Artificial Sequence
  Description of Artificial Sequence: Synthetic peptide
  Seed: KITEQEKDFLW (PIK3CA E542K)
KETEQEKDFLL

SEQ ID NO: 15036 - protein, 11 aa, Artificial Sequence
  Description of Artificial Sequence: Synthetic peptide
  Seed: KITEQEKDFLW (PIK3CA E542K)
KETEQEKDFLW

SEQ ID NO: 15037 - protein, 9 aa, Artificial Sequence
  Description of Artificial Sequence: Synthetic peptide
  Seed: KITEQEKDF (PIK3CA E542K)
KETEQEKDY

SEQ ID NO: 15038 - protein, 11 aa, Artificial Sequence
  Description of Artificial Sequence: Synthetic peptide
  Seed: KITEQEKDFLW (PIK3CA E542K)
KGTEQEKDFLF

SEQ ID NO: 15039 - protein, 9 aa, Artificial Sequence
  Description of Artificial Sequence: Synthetic peptide
  Seed: KITEQEKDF (PIK3CA E542K)
KGTEQEKDW

SEQ ID NO: 15040 - protein, 9 aa, Artificial Sequence
  Description of Artificial Sequence: Synthetic peptide
  Seed: KITEQEKDF (PIK3CA E542K)
KGTEQEKDY

SEQ ID NO: 15041 - protein, 10 aa, Artificial Sequence
  Description of Artificial Sequence: Synthetic peptide
  Seed: KITEQEKDFL (PIK3CA E542K)
KITEQEKDFF

SEQ ID NO: 15042 - protein, 11 aa, Artificial Sequence
  Description of Artificial Sequence: Synthetic peptide
  Seed: KITEQEKDFLW (PIK3CA E542K)
KITEQEKDFLF

SEQ ID NO: 15043 - protein, 11 aa, Artificial Sequence
  Description of Artificial Sequence: Synthetic peptide
  Seed: KITEQEKDFLW (PIK3CA E542K)
KITEQEKDFLI

SEQ ID NO: 15044 - protein, 11 aa, Artificial Sequence
  Description of Artificial Sequence: Synthetic peptide
  Seed: KITEQEKDFLW (PIK3CA E542K)
KITEQEKDFLL

SEQ ID NO: 15045 - protein, 11 aa, Artificial Sequence
  Description of Artificial Sequence: Synthetic peptide
  Seed: KITEQEKDFLW (PIK3CA E542K)
KITEQEKDFLM

SEQ ID NO: 15046 - protein, 11 aa, Artificial Sequence
  Description of Artificial Sequence: Synthetic peptide
  Seed: KITEQEKDFLW (PIK3CA E542K)
KITEQEKDFLY

SEQ ID NO: 15047 - protein, 10 aa, Artificial Sequence
  Description of Artificial Sequence: Synthetic peptide
  Seed: KITEQEKDFL (PIK3CA E542K)
KITEQEKDFW

SEQ ID NO: 15048 - protein, 9 aa, Artificial Sequence
  Description of Artificial Sequence: Synthetic peptide
  Seed: KITEQEKDF (PIK3CA E542K)
KITEQEKDI

SEQ ID NO: 15049 - protein, 9 aa, Artificial Sequence
  Description of Artificial Sequence: Synthetic peptide
  Seed: KITEQEKDF (PIK3CA E542K)
KITEQEKDL

SEQ ID NO: 15050 - protein, 9 aa, Artificial Sequence
  Description of Artificial Sequence: Synthetic peptide
  Seed: KITEQEKDF (PIK3CA E542K)
KITEQEKDM

SEQ ID NO: 15051 - protein, 9 aa, Artificial Sequence
  Description of Artificial Sequence: Synthetic peptide
  Seed: KITEQEKDF (PIK3CA E542K)
KITEQEKDW

SEQ ID NO: 15052 - protein, 9 aa, Artificial Sequence
  Description of Artificial Sequence: Synthetic peptide
  Seed: KITEQEKDF (PIK3CA E542K)
KITEQEKDY

SEQ ID NO: 15053 - protein, 9 aa, Artificial Sequence
  Description of Artificial Sequence: Synthetic peptide
  Seed: KITEQEKDF (PIK3CA E542K)
KLTEQEKDF

SEQ ID NO: 15054 - protein, 10 aa, Artificial Sequence
  Description of Artificial Sequence: Synthetic peptide
  Seed: KITEQEKDFL (PIK3CA E542K)
KLTEQEKDFF

SEQ ID NO: 15055 - protein, 10 aa, Artificial Sequence
  Description of Artificial Sequence: Synthetic peptide
  Seed: KITEQEKDFL (PIK3CA E542K)
KLTEQEKDFI

SEQ ID NO: 15056 - protein, 10 aa, Artificial Sequence
  Description of Artificial Sequence: Synthetic peptide
  Seed: KITEQEKDFL (PIK3CA E542K)
KLTEQEKDFL

SEQ ID NO: 15057 - protein, 11 aa, Artificial Sequence
  Description of Artificial Sequence: Synthetic peptide
  Seed: KITEQEKDFLW (PIK3CA E542K)
KLTEQEKDFLF

SEQ ID NO: 15058 - protein, 11 aa, Artificial Sequence
  Description of Artificial Sequence: Synthetic peptide
  Seed: KITEQEKDFLW (PIK3CA E542K)
KLTEQEKDFLI

SEQ ID NO: 15059 - protein, 11 aa, Artificial Sequence
  Description of Artificial Sequence: Synthetic peptide
  Seed: KITEQEKDFLW (PIK3CA E542K)
KLTEQEKDFLL

SEQ ID NO: 15060 - protein, 11 aa, Artificial Sequence
  Description of Artificial Sequence: Synthetic peptide
  Seed: KITEQEKDFLW (PIK3CA E542K)
KLTEQEKDFLM

SEQ ID NO: 15061 - protein, 11 aa, Artificial Sequence
  Description of Artificial Sequence: Synthetic peptide
  Seed: KITEQEKDFLW (PIK3CA E542K)
KLTEQEKDFLV

SEQ ID NO: 15062 - protein, 11 aa, Artificial Sequence
  Description of Artificial Sequence: Synthetic peptide
  Seed: KITEQEKDFLW (PIK3CA E542K)
KLTEQEKDFLY

SEQ ID NO: 15063 - protein, 10 aa, Artificial Sequence
  Description of Artificial Sequence: Synthetic peptide
  Seed: KITEQEKDFL (PIK3CA E542K)
KLTEQEKDFM

SEQ ID NO: 15064 - protein, 10 aa, Artificial Sequence
  Description of Artificial Sequence: Synthetic peptide
  Seed: KITEQEKDFL (PIK3CA E542K)
KLTEQEKDFW

SEQ ID NO: 15065 - protein, 9 aa, Artificial Sequence
  Description of Artificial Sequence: Synthetic peptide
  Seed: KITEQEKDF (PIK3CA E542K)
KLTEQEKDI

SEQ ID NO: 15066 - protein, 9 aa, Artificial Sequence
  Description of Artificial Sequence: Synthetic peptide
  Seed: KITEQEKDF (PIK3CA E542K)
KLTEQEKDL

SEQ ID NO: 15067 - protein, 9 aa, Artificial Sequence
  Description of Artificial Sequence: Synthetic peptide
  Seed: KITEQEKDF (PIK3CA E542K)
KLTEQEKDM

SEQ ID NO: 15068 - protein, 9 aa, Artificial Sequence
  Description of Artificial Sequence: Synthetic peptide
  Seed: KITEQEKDF (PIK3CA E542K)
KLTEQEKDV

SEQ ID NO: 15069 - protein, 9 aa, Artificial Sequence
  Description of Artificial Sequence: Synthetic peptide
  Seed: KITEQEKDF (PIK3CA E542K)
KLTEQEKDW

SEQ ID NO: 15070 - protein, 9 aa, Artificial Sequence
  Description of Artificial Sequence: Synthetic peptide
  Seed: KITEQEKDF (PIK3CA E542K)
KLTEQEKDY

SEQ ID NO: 15071 - protein, 9 aa, Artificial Sequence
  Description of Artificial Sequence: Synthetic peptide
  Seed: KITEQEKDF (PIK3CA E542K)
KMTEQEKDF

SEQ ID NO: 15072 - protein, 10 aa, Artificial Sequence
  Description of Artificial Sequence: Synthetic peptide
  Seed: KITEQEKDFL (PIK3CA E542K)
KMTEQEKDFF

SEQ ID NO: 15073 - protein, 10 aa, Artificial Sequence
  Description of Artificial Sequence: Synthetic peptide
  Seed: KITEQEKDFL (PIK3CA E542K)
KMTEQEKDFI

SEQ ID NO: 15074 - protein, 10 aa, Artificial Sequence
  Description of Artificial Sequence: Synthetic peptide
  Seed: KITEQEKDFL (PIK3CA E542K)
KMTEQEKDFL

SEQ ID NO: 15075 - protein, 11 aa, Artificial Sequence
  Description of Artificial Sequence: Synthetic peptide
  Seed: KITEQEKDFLW (PIK3CA E542K)
KMTEQEKDFLF

SEQ ID NO: 15076 - protein, 11 aa, Artificial Sequence
  Description of Artificial Sequence: Synthetic peptide
  Seed: KITEQEKDFLW (PIK3CA E542K)
KMTEQEKDFLI

SEQ ID NO: 15077 - protein, 11 aa, Artificial Sequence
  Description of Artificial Sequence: Synthetic peptide
  Seed: KITEQEKDFLW (PIK3CA E542K)
KMTEQEKDFLL

SEQ ID NO: 15078 - protein, 11 aa, Artificial Sequence
  Description of Artificial Sequence: Synthetic peptide
  Seed: KITEQEKDFLW (PIK3CA E542K)
KMTEQEKDFLM

SEQ ID NO: 15079 - protein, 11 aa, Artificial Sequence
  Description of Artificial Sequence: Synthetic peptide
  Seed: KITEQEKDFLW (PIK3CA E542K)
KMTEQEKDFLV

SEQ ID NO: 15080 - protein, 11 aa, Artificial Sequence
  Description of Artificial Sequence: Synthetic peptide
  Seed: KITEQEKDFLW (PIK3CA E542K)
KMTEQEKDFLY

SEQ ID NO: 15081 - protein, 10 aa, Artificial Sequence
  Description of Artificial Sequence: Synthetic peptide
  Seed: KITEQEKDFL (PIK3CA E542K)
KMTEQEKDFM

SEQ ID NO: 15082 - protein, 10 aa, Artificial Sequence
  Description of Artificial Sequence: Synthetic peptide
  Seed: KITEQEKDFL (PIK3CA E542K)
KMTEQEKDFV

SEQ ID NO: 15083 - protein, 10 aa, Artificial Sequence
  Description of Artificial Sequence: Synthetic peptide
  Seed: KITEQEKDFL (PIK3CA E542K)
KMTEQEKDFW

SEQ ID NO: 15084 - protein, 9 aa, Artificial Sequence
  Description of Artificial Sequence: Synthetic peptide
  Seed: KITEQEKDF (PIK3CA E542K)
KMTEQEKDI

SEQ ID NO: 15085 - protein, 9 aa, Artificial Sequence
  Description of Artificial Sequence: Synthetic peptide
  Seed: KITEQEKDF (PIK3CA E542K)
KMTEQEKDL

SEQ ID NO: 15086 - protein, 9 aa, Artificial Sequence
  Description of Artificial Sequence: Synthetic peptide
  Seed: KITEQEKDF (PIK3CA E542K)
KMTEQEKDM

SEQ ID NO: 15087 - protein, 9 aa, Artificial Sequence
  Description of Artificial Sequence: Synthetic peptide
  Seed: KITEQEKDF (PIK3CA E542K)
KMTEQEKDV

SEQ ID NO: 15088 - protein, 9 aa, Artificial Sequence
  Description of Artificial Sequence: Synthetic peptide
  Seed: KITEQEKDF (PIK3CA E542K)
KMTEQEKDW

SEQ ID NO: 15089 - protein, 9 aa, Artificial Sequence
  Description of Artificial Sequence: Synthetic peptide
  Seed: KITEQEKDF (PIK3CA E542K)
KMTEQEKDY

SEQ ID NO: 15090 - protein, 11 aa, Artificial Sequence
  Description of Artificial Sequence: Synthetic peptide
  Seed: KITEQEKDFLW (PIK3CA E542K)
KNTEQEKDFLW

SEQ ID NO: 15091 - protein, 9 aa, Artificial Sequence
  Description of Artificial Sequence: Synthetic peptide
  Seed: KITEQEKDF (PIK3CA E542K)
KNTEQEKDW

SEQ ID NO: 15092 - protein, 11 aa, Artificial Sequence
  Description of Artificial Sequence: Synthetic peptide
  Seed: KITEQEKDFLW (PIK3CA E542K)
KPTEQEKDFLW

SEQ ID NO: 15093 - protein, 9 aa, Artificial Sequence
  Description of Artificial Sequence: Synthetic peptide
  Seed: KITEQEKDF (PIK3CA E542K)
KPTEQEKDW

SEQ ID NO: 15094 - protein, 9 aa, Artificial Sequence
  Description of Artificial Sequence: Synthetic peptide
  Seed: KITEQEKDF (PIK3CA E542K)
KPTEQEKDY

SEQ ID NO: 15095 - protein, 9 aa, Artificial Sequence
  Description of Artificial Sequence: Synthetic peptide
  Seed: KITEQEKDF (PIK3CA E542K)
KQTEQEKDF

SEQ ID NO: 15096 - protein, 10 aa, Artificial Sequence
  Description of Artificial Sequence: Synthetic peptide
  Seed: KITEQEKDFL (PIK3CA E542K)
KQTEQEKDFF

SEQ ID NO: 15097 - protein, 10 aa, Artificial Sequence
  Description of Artificial Sequence: Synthetic peptide
  Seed: KITEQEKDFL (PIK3CA E542K)
KQTEQEKDFI

SEQ ID NO: 15098 - protein, 10 aa, Artificial Sequence
  Description of Artificial Sequence: Synthetic peptide
  Seed: KITEQEKDFL (PIK3CA E542K)
KQTEQEKDFL

SEQ ID NO: 15099 - protein, 11 aa, Artificial Sequence
  Description of Artificial Sequence: Synthetic peptide
  Seed: KITEQEKDFLW (PIK3CA E542K)
KQTEQEKDFLF

SEQ ID NO: 15100 - protein, 11 aa, Artificial Sequence
  Description of Artificial Sequence: Synthetic peptide
  Seed: KITEQEKDFLW (PIK3CA E542K)
KQTEQEKDFLI

SEQ ID NO: 15101 - protein, 11 aa, Artificial Sequence
  Description of Artificial Sequence: Synthetic peptide
  Seed: KITEQEKDFLW (PIK3CA E542K)
KQTEQEKDFLL

SEQ ID NO: 15102 - protein, 11 aa, Artificial Sequence
  Description of Artificial Sequence: Synthetic peptide
  Seed: KITEQEKDFLW (PIK3CA E542K)
KQTEQEKDFLM

SEQ ID NO: 15103 - protein, 11 aa, Artificial Sequence
  Description of Artificial Sequence: Synthetic peptide
  Seed: KITEQEKDFLW (PIK3CA E542K)
KQTEQEKDFLV

SEQ ID NO: 15104 - protein, 11 aa, Artificial Sequence
  Description of Artificial Sequence: Synthetic peptide
  Seed: KITEQEKDFLW (PIK3CA E542K)
KQTEQEKDFLY

SEQ ID NO: 15105 - protein, 10 aa, Artificial Sequence
  Description of Artificial Sequence: Synthetic peptide
  Seed: KITEQEKDFL (PIK3CA E542K)
KQTEQEKDFM

SEQ ID NO: 15106 - protein, 10 aa, Artificial Sequence
  Description of Artificial Sequence: Synthetic peptide
  Seed: KITEQEKDFL (PIK3CA E542K)
KQTEQEKDFV

SEQ ID NO: 15107 - protein, 10 aa, Artificial Sequence
  Description of Artificial Sequence: Synthetic peptide
  Seed: KITEQEKDFL (PIK3CA E542K)
KQTEQEKDFW

SEQ ID NO: 15108 - protein, 10 aa, Artificial Sequence
  Description of Artificial Sequence: Synthetic peptide
  Seed: KITEQEKDFL (PIK3CA E542K)
KQTEQEKDFY

SEQ ID NO: 15109 - protein, 9 aa, Artificial Sequence
  Description of Artificial Sequence: Synthetic peptide
  Seed: KITEQEKDF (PIK3CA E542K)
KQTEQEKDI

SEQ ID NO: 15110 - protein, 9 aa, Artificial Sequence
  Description of Artificial Sequence: Synthetic peptide
  Seed: KITEQEKDF (PIK3CA E542K)
KQTEQEKDL

SEQ ID NO: 15111 - protein, 9 aa, Artificial Sequence
  Description of Artificial Sequence: Synthetic peptide
  Seed: KITEQEKDF (PIK3CA E542K)
KQTEQEKDM

SEQ ID NO: 15112 - protein, 9 aa, Artificial Sequence
  Description of Artificial Sequence: Synthetic peptide
  Seed: KITEQEKDF (PIK3CA E542K)
KQTEQEKDV

SEQ ID NO: 15113 - protein, 9 aa, Artificial Sequence
  Description of Artificial Sequence: Synthetic peptide
  Seed: KITEQEKDF (PIK3CA E542K)
KQTEQEKDW

SEQ ID NO: 15114 - protein, 9 aa, Artificial Sequence
  Description of Artificial Sequence: Synthetic peptide
  Seed: KITEQEKDF (PIK3CA E542K)
KQTEQEKDY

SEQ ID NO: 15115 - protein, 9 aa, Artificial Sequence
  Description of Artificial Sequence: Synthetic peptide
  Seed: KITEQEKDF (PIK3CA E542K)
KSTEQEKDF

SEQ ID NO: 15116 - protein, 11 aa, Artificial Sequence
  Description of Artificial Sequence: Synthetic peptide
  Seed: KITEQEKDFLW (PIK3CA E542K)
KSTEQEKDFLI

SEQ ID NO: 15117 - protein, 11 aa, Artificial Sequence
  Description of Artificial Sequence: Synthetic peptide
  Seed: KITEQEKDFLW (PIK3CA E542K)
KSTEQEKDFLL

SEQ ID NO: 15118 - protein, 11 aa, Artificial Sequence
  Description of Artificial Sequence: Synthetic peptide
  Seed: KITEQEKDFLW (PIK3CA E542K)
KSTEQEKDFLV

SEQ ID NO: 15119 - protein, 9 aa, Artificial Sequence
  Description of Artificial Sequence: Synthetic peptide
  Seed: KITEQEKDF (PIK3CA E542K)
KSTEQEKDI

SEQ ID NO: 15120 - protein, 9 aa, Artificial Sequence
  Description of Artificial Sequence: Synthetic peptide
  Seed: KITEQEKDF (PIK3CA E542K)
KSTEQEKDL

SEQ ID NO: 15121 - protein, 9 aa, Artificial Sequence
  Description of Artificial Sequence: Synthetic peptide
  Seed: KITEQEKDF (PIK3CA E542K)
KSTEQEKDM

SEQ ID NO: 15122 - protein, 9 aa, Artificial Sequence
  Description of Artificial Sequence: Synthetic peptide
  Seed: KITEQEKDF (PIK3CA E542K)
KSTEQEKDW

SEQ ID NO: 15123 - protein, 9 aa, Artificial Sequence
  Description of Artificial Sequence: Synthetic peptide
  Seed: KITEQEKDF (PIK3CA E542K)
KSTEQEKDY

SEQ ID NO: 15124 - protein, 9 aa, Artificial Sequence
  Description of Artificial Sequence: Synthetic peptide
  Seed: KITEQEKDF (PIK3CA E542K)
KTTEQEKDF

SEQ ID NO: 15125 - protein, 11 aa, Artificial Sequence
  Description of Artificial Sequence: Synthetic peptide
  Seed: KITEQEKDFLW (PIK3CA E542K)
KTTEQEKDFLI

SEQ ID NO: 15126 - protein, 11 aa, Artificial Sequence
  Description of Artificial Sequence: Synthetic peptide
  Seed: KITEQEKDFLW (PIK3CA E542K)
KTTEQEKDFLL

SEQ ID NO: 15127 - protein, 11 aa, Artificial Sequence
  Description of Artificial Sequence: Synthetic peptide
  Seed: KITEQEKDFLW (PIK3CA E542K)
KTTEQEKDFLM

SEQ ID NO: 15128 - protein, 11 aa, Artificial Sequence
  Description of Artificial Sequence: Synthetic peptide
  Seed: KITEQEKDFLW (PIK3CA E542K)
KTTEQEKDFLV

SEQ ID NO: 15129 - protein, 9 aa, Artificial Sequence
  Description of Artificial Sequence: Synthetic peptide
  Seed: KITEQEKDF (PIK3CA E542K)
KTTEQEKDI

SEQ ID NO: 15130 - protein, 9 aa, Artificial Sequence
  Description of Artificial Sequence: Synthetic peptide
  Seed: KITEQEKDF (PIK3CA E542K)
KTTEQEKDL

SEQ ID NO: 15131 - protein, 9 aa, Artificial Sequence
  Description of Artificial Sequence: Synthetic peptide
  Seed: KITEQEKDF (PIK3CA E542K)
KTTEQEKDM

SEQ ID NO: 15132 - protein, 9 aa, Artificial Sequence
  Description of Artificial Sequence: Synthetic peptide
  Seed: KITEQEKDF (PIK3CA E542K)
KTTEQEKDW

SEQ ID NO: 15133 - protein, 9 aa, Artificial Sequence
  Description of Artificial Sequence: Synthetic peptide
  Seed: KITEQEKDF (PIK3CA E542K)
KTTEQEKDY

SEQ ID NO: 15134 - protein, 9 aa, Artificial Sequence
  Description of Artificial Sequence: Synthetic peptide
  Seed: KITEQEKDF (PIK3CA E542K)
KVTEQEKDF

SEQ ID NO: 15135 - protein, 10 aa, Artificial Sequence
  Description of Artificial Sequence: Synthetic peptide
  Seed: KITEQEKDFL (PIK3CA E542K)
KVTEQEKDFF

SEQ ID NO: 15136 - protein, 10 aa, Artificial Sequence
  Description of Artificial Sequence: Synthetic peptide
  Seed: KITEQEKDFL (PIK3CA E542K)
KVTEQEKDFL

SEQ ID NO: 15137 - protein, 11 aa, Artificial Sequence
  Description of Artificial Sequence: Synthetic peptide
  Seed: KITEQEKDFLW (PIK3CA E542K)
KVTEQEKDFLF

SEQ ID NO: 15138 - protein, 11 aa, Artificial Sequence
  Description of Artificial Sequence: Synthetic peptide
  Seed: KITEQEKDFLW (PIK3CA E542K)
KVTEQEKDFLI

SEQ ID NO: 15139 - protein, 11 aa, Artificial Sequence
  Description of Artificial Sequence: Synthetic peptide
  Seed: KITEQEKDFLW (PIK3CA E542K)
KVTEQEKDFLL

SEQ ID NO: 15140 - protein, 11 aa, Artificial Sequence
  Description of Artificial Sequence: Synthetic peptide
  Seed: KITEQEKDFLW (PIK3CA E542K)
KVTEQEKDFLM

SEQ ID NO: 15141 - protein, 11 aa, Artificial Sequence
  Description of Artificial Sequence: Synthetic peptide
  Seed: KITEQEKDFLW (PIK3CA E542K)
KVTEQEKDFLY

SEQ ID NO: 15142 - protein, 10 aa, Artificial Sequence
  Description of Artificial Sequence: Synthetic peptide
  Seed: KITEQEKDFL (PIK3CA E542K)
KVTEQEKDFW

SEQ ID NO: 15143 - protein, 9 aa, Artificial Sequence
  Description of Artificial Sequence: Synthetic peptide
  Seed: KITEQEKDF (PIK3CA E542K)
KVTEQEKDI

SEQ ID NO: 15144 - protein, 9 aa, Artificial Sequence
  Description of Artificial Sequence: Synthetic peptide
  Seed: KITEQEKDF (PIK3CA E542K)
KVTEQEKDL

SEQ ID NO: 15145 - protein, 9 aa, Artificial Sequence
  Description of Artificial Sequence: Synthetic peptide
  Seed: KITEQEKDF (PIK3CA E542K)
KVTEQEKDM

SEQ ID NO: 15146 - protein, 9 aa, Artificial Sequence
  Description of Artificial Sequence: Synthetic peptide
  Seed: KITEQEKDF (PIK3CA E542K)
KVTEQEKDW

SEQ ID NO: 15147 - protein, 9 aa, Artificial Sequence
  Description of Artificial Sequence: Synthetic peptide
  Seed: KITEQEKDF (PIK3CA E542K)
KVTEQEKDY

SEQ ID NO: 15148 - protein, 11 aa, Artificial Sequence
  Description of Artificial Sequence: Synthetic peptide
  Seed: KITEQEKDFLW (PIK3CA E542K)
KWTEQEKDFLW

SEQ ID NO: 15149 - protein, 9 aa, Artificial Sequence
  Description of Artificial Sequence: Synthetic peptide
  Seed: LSKITEQEK (PIK3CA E542K)
LAKITEQEF

SEQ ID NO: 15150 - protein, 9 aa, Artificial Sequence
  Description of Artificial Sequence: Synthetic peptide
  Seed: LSKITEQEK (PIK3CA E542K)
LAKITEQEI

SEQ ID NO: 15151 - protein, 9 aa, Artificial Sequence
  Description of Artificial Sequence: Synthetic peptide
  Seed: LSKITEQEK (PIK3CA E542K)
LAKITEQEK

SEQ ID NO: 15152 - protein, 11 aa, Artificial Sequence
  Description of Artificial Sequence: Synthetic peptide
  Seed: LSKITEQEKDF (PIK3CA E542K)
LAKITEQEKDW

SEQ ID NO: 15153 - protein, 9 aa, Artificial Sequence
  Description of Artificial Sequence: Synthetic peptide
  Seed: LSKITEQEK (PIK3CA E542K)
LAKITEQEL

SEQ ID NO: 15154 - protein, 9 aa, Artificial Sequence
  Description of Artificial Sequence: Synthetic peptide
  Seed: LSKITEQEK (PIK3CA E542K)
LAKITEQEM

SEQ ID NO: 15155 - protein, 9 aa, Artificial Sequence
  Description of Artificial Sequence: Synthetic peptide
  Seed: LSKITEQEK (PIK3CA E542K)
LAKITEQER

SEQ ID NO: 15156 - protein, 9 aa, Artificial Sequence
  Description of Artificial Sequence: Synthetic peptide
  Seed: LSKITEQEK (PIK3CA E542K)
LAKITEQEV

SEQ ID NO: 15157 - protein, 9 aa, Artificial Sequence
  Description of Artificial Sequence: Synthetic peptide
  Seed: LSKITEQEK (PIK3CA E542K)
LAKITEQEW

SEQ ID NO: 15158 - protein, 9 aa, Artificial Sequence
  Description of Artificial Sequence: Synthetic peptide
  Seed: LSKITEQEK (PIK3CA E542K)
LAKITEQEY

SEQ ID NO: 15159 - protein, 9 aa, Artificial Sequence
  Description of Artificial Sequence: Synthetic peptide
  Seed: LSKITEQEK (PIK3CA E542K)
LCKITEQEF

SEQ ID NO: 15160 - protein, 11 aa, Artificial Sequence
  Description of Artificial Sequence: Synthetic peptide
  Seed: LSKITEQEKDF (PIK3CA E542K)
LCKITEQEKDW

SEQ ID NO: 15161 - protein, 9 aa, Artificial Sequence
  Description of Artificial Sequence: Synthetic peptide
  Seed: LSKITEQEK (PIK3CA E542K)
LCKITEQEL

SEQ ID NO: 15162 - protein, 9 aa, Artificial Sequence
  Description of Artificial Sequence: Synthetic peptide
  Seed: LSKITEQEK (PIK3CA E542K)
LCKITEQEM

SEQ ID NO: 15163 - protein, 9 aa, Artificial Sequence
  Description of Artificial Sequence: Synthetic peptide
  Seed: LSKITEQEK (PIK3CA E542K)
LCKITEQEY

SEQ ID NO: 15164 - protein, 9 aa, Artificial Sequence
  Description of Artificial Sequence: Synthetic peptide
  Seed: LSKITEQEK (PIK3CA E542K)
LDKITEQEK

SEQ ID NO: 15165 - protein, 9 aa, Artificial Sequence
  Description of Artificial Sequence: Synthetic peptide
  Seed: LSKITEQEK (PIK3CA E542K)
LDKITEQEY

SEQ ID NO: 15166 - protein, 9 aa, Artificial Sequence
  Description of Artificial Sequence: Synthetic peptide
  Seed: LSKITEQEK (PIK3CA E542K)
LEKITEQEK

SEQ ID NO: 15167 - protein, 9 aa, Artificial Sequence
  Description of Artificial Sequence: Synthetic peptide
  Seed: LSKITEQEK (PIK3CA E542K)
LFKITEQEF

SEQ ID NO: 15168 - protein, 9 aa, Artificial Sequence
  Description of Artificial Sequence: Synthetic peptide
  Seed: LSKITEQEK (PIK3CA E542K)
LFKITEQEL

SEQ ID NO: 15169 - protein, 9 aa, Artificial Sequence
  Description of Artificial Sequence: Synthetic peptide
  Seed: LSKITEQEK (PIK3CA E542K)
LFKITEQEM

SEQ ID NO: 15170 - protein, 9 aa, Artificial Sequence
  Description of Artificial Sequence: Synthetic peptide
  Seed: LSKITEQEK (PIK3CA E542K)
LFKITEQEY

SEQ ID NO: 15171 - protein, 9 aa, Artificial Sequence
  Description of Artificial Sequence: Synthetic peptide
  Seed: LSKITEQEK (PIK3CA E542K)
LGKITEQEF

SEQ ID NO: 15172 - protein, 9 aa, Artificial Sequence
  Description of Artificial Sequence: Synthetic peptide
  Seed: LSKITEQEK (PIK3CA E542K)
LGKITEQEK

SEQ ID NO: 15173 - protein, 11 aa, Artificial Sequence
  Description of Artificial Sequence: Synthetic peptide
  Seed: LSKITEQEKDF (PIK3CA E542K)
LGKITEQEKDW

SEQ ID NO: 15174 - protein, 9 aa, Artificial Sequence
  Description of Artificial Sequence: Synthetic peptide
  Seed: LSKITEQEK (PIK3CA E542K)
LGKITEQEL

SEQ ID NO: 15175 - protein, 9 aa, Artificial Sequence
  Description of Artificial Sequence: Synthetic peptide
  Seed: LSKITEQEK (PIK3CA E542K)
LGKITEQEM

SEQ ID NO: 15176 - protein, 9 aa, Artificial Sequence
  Description of Artificial Sequence: Synthetic peptide
  Seed: LSKITEQEK (PIK3CA E542K)
LGKITEQEY

SEQ ID NO: 15177 - protein, 9 aa, Artificial Sequence
  Description of Artificial Sequence: Synthetic peptide
  Seed: LSKITEQEK (PIK3CA E542K)
LIKITEQEF

SEQ ID NO: 15178 - protein, 9 aa, Artificial Sequence
  Description of Artificial Sequence: Synthetic peptide
  Seed: LSKITEQEK (PIK3CA E542K)
LIKITEQEK

SEQ ID NO: 15179 - protein, 11 aa, Artificial Sequence
  Description of Artificial Sequence: Synthetic peptide
  Seed: LSKITEQEKDF (PIK3CA E542K)
LIKITEQEKDW

SEQ ID NO: 15180 - protein, 9 aa, Artificial Sequence
  Description of Artificial Sequence: Synthetic peptide
  Seed: LSKITEQEK (PIK3CA E542K)
LIKITEQEL

SEQ ID NO: 15181 - protein, 9 aa, Artificial Sequence
  Description of Artificial Sequence: Synthetic peptide
  Seed: LSKITEQEK (PIK3CA E542K)
LIKITEQEM

SEQ ID NO: 15182 - protein, 9 aa, Artificial Sequence
  Description of Artificial Sequence: Synthetic peptide
  Seed: LSKITEQEK (PIK3CA E542K)
LIKITEQER

SEQ ID NO: 15183 - protein, 9 aa, Artificial Sequence
  Description of Artificial Sequence: Synthetic peptide
  Seed: LSKITEQEK (PIK3CA E542K)
LIKITEQEY

SEQ ID NO: 15184 - protein, 9 aa, Artificial Sequence
  Description of Artificial Sequence: Synthetic peptide
  Seed: LSKITEQEK (PIK3CA E542K)
LLKITEQEF

SEQ ID NO: 15185 - protein, 9 aa, Artificial Sequence
  Description of Artificial Sequence: Synthetic peptide
  Seed: LSKITEQEK (PIK3CA E542K)
LLKITEQEK

SEQ ID NO: 15186 - protein, 11 aa, Artificial Sequence
  Description of Artificial Sequence: Synthetic peptide
  Seed: LSKITEQEKDF (PIK3CA E542K)
LLKITEQEKDW

SEQ ID NO: 15187 - protein, 9 aa, Artificial Sequence
  Description of Artificial Sequence: Synthetic peptide
  Seed: LSKITEQEK (PIK3CA E542K)
LLKITEQEL

SEQ ID NO: 15188 - protein, 9 aa, Artificial Sequence
  Description of Artificial Sequence: Synthetic peptide
  Seed: LSKITEQEK (PIK3CA E542K)
LLKITEQEM

SEQ ID NO: 15189 - protein, 9 aa, Artificial Sequence
  Description of Artificial Sequence: Synthetic peptide
  Seed: LSKITEQEK (PIK3CA E542K)
LLKITEQER

SEQ ID NO: 15190 - protein, 9 aa, Artificial Sequence
  Description of Artificial Sequence: Synthetic peptide
  Seed: LSKITEQEK (PIK3CA E542K)
LLKITEQEY

SEQ ID NO: 15191 - protein, 9 aa, Artificial Sequence
  Description of Artificial Sequence: Synthetic peptide
  Seed: LSKITEQEK (PIK3CA E542K)
LMKITEQEF

SEQ ID NO: 15192 - protein, 11 aa, Artificial Sequence
  Description of Artificial Sequence: Synthetic peptide
  Seed: LSKITEQEKDF (PIK3CA E542K)
LMKITEQEKDW

SEQ ID NO: 15193 - protein, 9 aa, Artificial Sequence
  Description of Artificial Sequence: Synthetic peptide
  Seed: LSKITEQEK (PIK3CA E542K)
LMKITEQEL

SEQ ID NO: 15194 - protein, 9 aa, Artificial Sequence
  Description of Artificial Sequence: Synthetic peptide
  Seed: LSKITEQEK (PIK3CA E542K)
LMKITEQEM

SEQ ID NO: 15195 - protein, 9 aa, Artificial Sequence
  Description of Artificial Sequence: Synthetic peptide
  Seed: LSKITEQEK (PIK3CA E542K)
LMKITEQER

SEQ ID NO: 15196 - protein, 9 aa, Artificial Sequence
  Description of Artificial Sequence: Synthetic peptide
  Seed: LSKITEQEK (PIK3CA E542K)
LMKITEQEY

SEQ ID NO: 15197 - protein, 9 aa, Artificial Sequence
  Description of Artificial Sequence: Synthetic peptide
  Seed: LSKITEQEK (PIK3CA E542K)
LNKITEQEK

SEQ ID NO: 15198 - protein, 11 aa, Artificial Sequence
  Description of Artificial Sequence: Synthetic peptide
  Seed: LSKITEQEKDF (PIK3CA E542K)
LNKITEQEKDW

SEQ ID NO: 15199 - protein, 9 aa, Artificial Sequence
  Description of Artificial Sequence: Synthetic peptide
  Seed: LSKITEQEK (PIK3CA E542K)
LNKITEQEY

SEQ ID NO: 15200 - protein, 9 aa, Artificial Sequence
  Description of Artificial Sequence: Synthetic peptide
  Seed: LSKITEQEK (PIK3CA E542K)
LQKITEQEF

SEQ ID NO: 15201 - protein, 9 aa, Artificial Sequence
  Description of Artificial Sequence: Synthetic peptide
  Seed: LSKITEQEK (PIK3CA E542K)
LQKITEQEK

SEQ ID NO: 15202 - protein, 11 aa, Artificial Sequence
  Description of Artificial Sequence: Synthetic peptide
  Seed: LSKITEQEKDF (PIK3CA E542K)
LQKITEQEKDW

SEQ ID NO: 15203 - protein, 9 aa, Artificial Sequence
  Description of Artificial Sequence: Synthetic peptide
  Seed: LSKITEQEK (PIK3CA E542K)
LQKITEQEM

SEQ ID NO: 15204 - protein, 9 aa, Artificial Sequence
  Description of Artificial Sequence: Synthetic peptide
  Seed: LSKITEQEK (PIK3CA E542K)
LQKITEQER

SEQ ID NO: 15205 - protein, 9 aa, Artificial Sequence
  Description of Artificial Sequence: Synthetic peptide
  Seed: LSKITEQEK (PIK3CA E542K)
LQKITEQEY

SEQ ID NO: 15206 - protein, 9 aa, Artificial Sequence
  Description of Artificial Sequence: Synthetic peptide
  Seed: LSKITEQEK (PIK3CA E542K)
LSKITEQEF

SEQ ID NO: 15207 - protein, 9 aa, Artificial Sequence
  Description of Artificial Sequence: Synthetic peptide
  Seed: LSKITEQEK (PIK3CA E542K)
LSKITEQEI

SEQ ID NO: 15208 - protein, 11 aa, Artificial Sequence
  Description of Artificial Sequence: Synthetic peptide
  Seed: LSKITEQEKDF (PIK3CA E542K)
LSKITEQEKDW

SEQ ID NO: 15209 - protein, 9 aa, Artificial Sequence
  Description of Artificial Sequence: Synthetic peptide
  Seed: LSKITEQEK (PIK3CA E542K)
LSKITEQEL

SEQ ID NO: 15210 - protein, 9 aa, Artificial Sequence
  Description of Artificial Sequence: Synthetic peptide
  Seed: LSKITEQEK (PIK3CA E542K)
LSKITEQEM

SEQ ID NO: 15211 - protein, 9 aa, Artificial Sequence
  Description of Artificial Sequence: Synthetic peptide
  Seed: LSKITEQEK (PIK3CA E542K)
LSKITEQER

SEQ ID NO: 15212 - protein, 9 aa, Artificial Sequence
  Description of Artificial Sequence: Synthetic peptide
  Seed: LSKITEQEK (PIK3CA E542K)
LSKITEQEV

SEQ ID NO: 15213 - protein, 9 aa, Artificial Sequence
  Description of Artificial Sequence: Synthetic peptide
  Seed: LSKITEQEK (PIK3CA E542K)
LSKITEQEW

SEQ ID NO: 15214 - protein, 9 aa, Artificial Sequence
  Description of Artificial Sequence: Synthetic peptide
  Seed: LSKITEQEK (PIK3CA E542K)
LSKITEQEY

SEQ ID NO: 15215 - protein, 9 aa, Artificial Sequence
  Description of Artificial Sequence: Synthetic peptide
  Seed: LSKITEQEK (PIK3CA E542K)
LTKITEQEF

SEQ ID NO: 15216 - protein, 9 aa, Artificial Sequence
  Description of Artificial Sequence: Synthetic peptide
  Seed: LSKITEQEK (PIK3CA E542K)
LTKITEQEI

SEQ ID NO: 15217 - protein, 11 aa, Artificial Sequence
  Description of Artificial Sequence: Synthetic peptide
  Seed: LSKITEQEKDF (PIK3CA E542K)
LTKITEQEKDF

SEQ ID NO: 15218 - protein, 11 aa, Artificial Sequence
  Description of Artificial Sequence: Synthetic peptide
  Seed: LSKITEQEKDF (PIK3CA E542K)
LTKITEQEKDW

SEQ ID NO: 15219 - protein, 9 aa, Artificial Sequence
  Description of Artificial Sequence: Synthetic peptide
  Seed: LSKITEQEK (PIK3CA E542K)
LTKITEQEL

SEQ ID NO: 15220 - protein, 9 aa, Artificial Sequence
  Description of Artificial Sequence: Synthetic peptide
  Seed: LSKITEQEK (PIK3CA E542K)
LTKITEQEM

SEQ ID NO: 15221 - protein, 9 aa, Artificial Sequence
  Description of Artificial Sequence: Synthetic peptide
  Seed: LSKITEQEK (PIK3CA E542K)
LTKITEQER

SEQ ID NO: 15222 - protein, 9 aa, Artificial Sequence
  Description of Artificial Sequence: Synthetic peptide
  Seed: LSKITEQEK (PIK3CA E542K)
LTKITEQEV

SEQ ID NO: 15223 - protein, 9 aa, Artificial Sequence
  Description of Artificial Sequence: Synthetic peptide
  Seed: LSKITEQEK (PIK3CA E542K)
LTKITEQEW

SEQ ID NO: 15224 - protein, 9 aa, Artificial Sequence
  Description of Artificial Sequence: Synthetic peptide
  Seed: LSKITEQEK (PIK3CA E542K)
LTKITEQEY

SEQ ID NO: 15225 - protein, 9 aa, Artificial Sequence
  Description of Artificial Sequence: Synthetic peptide
  Seed: LSKITEQEK (PIK3CA E542K)
LVKITEQEF

SEQ ID NO: 15226 - protein, 9 aa, Artificial Sequence
  Description of Artificial Sequence: Synthetic peptide
  Seed: LSKITEQEK (PIK3CA E542K)
LVKITEQEI

SEQ ID NO: 15227 - protein, 11 aa, Artificial Sequence
  Description of Artificial Sequence: Synthetic peptide
  Seed: LSKITEQEKDF (PIK3CA E542K)
LVKITEQEKDW

SEQ ID NO: 15228 - protein, 9 aa, Artificial Sequence
  Description of Artificial Sequence: Synthetic peptide
  Seed: LSKITEQEK (PIK3CA E542K)
LVKITEQEL

SEQ ID NO: 15229 - protein, 9 aa, Artificial Sequence
  Description of Artificial Sequence: Synthetic peptide
  Seed: LSKITEQEK (PIK3CA E542K)
LVKITEQEM

SEQ ID NO: 15230 - protein, 9 aa, Artificial Sequence
  Description of Artificial Sequence: Synthetic peptide
  Seed: LSKITEQEK (PIK3CA E542K)
LVKITEQER

SEQ ID NO: 15231 - protein, 9 aa, Artificial Sequence
  Description of Artificial Sequence: Synthetic peptide
  Seed: LSKITEQEK (PIK3CA E542K)
LVKITEQEY

SEQ ID NO: 15232 - protein, 9 aa, Artificial Sequence
  Description of Artificial Sequence: Synthetic peptide
  Seed: LSKITEQEK (PIK3CA E542K)
LYKITEQEF

SEQ ID NO: 15233 - protein, 9 aa, Artificial Sequence
  Description of Artificial Sequence: Synthetic peptide
  Seed: LSKITEQEK (PIK3CA E542K)
LYKITEQEY

SEQ ID NO: 15234 - protein, 9 aa, Artificial Sequence
  Description of Artificial Sequence: Synthetic peptide
  Seed: STRDPLSKI (PIK3CA E542K)
SARDPLSKC

SEQ ID NO: 15235 - protein, 9 aa, Artificial Sequence
  Description of Artificial Sequence: Synthetic peptide
  Seed: STRDPLSKI (PIK3CA E542K)
SARDPLSKE

SEQ ID NO: 15236 - protein, 9 aa, Artificial Sequence
  Description of Artificial Sequence: Synthetic peptide
  Seed: STRDPLSKI (PIK3CA E542K)
SARDPLSKG

SEQ ID NO: 15237 - protein, 9 aa, Artificial Sequence
  Description of Artificial Sequence: Synthetic peptide
  Seed: STRDPLSKI (PIK3CA E542K)
SARDPLSKH

SEQ ID NO: 15238 - protein, 9 aa, Artificial Sequence
  Description of Artificial Sequence: Synthetic peptide
  Seed: STRDPLSKI (PIK3CA E542K)
SARDPLSKN

SEQ ID NO: 15239 - protein, 9 aa, Artificial Sequence
  Description of Artificial Sequence: Synthetic peptide
  Seed: STRDPLSKI (PIK3CA E542K)
SARDPLSKP

SEQ ID NO: 15240 - protein, 9 aa, Artificial Sequence
  Description of Artificial Sequence: Synthetic peptide
  Seed: STRDPLSKI (PIK3CA E542K)
SARDPLSKQ

SEQ ID NO: 15241 - protein, 9 aa, Artificial Sequence
  Description of Artificial Sequence: Synthetic peptide
  Seed: STRDPLSKI (PIK3CA E542K)
SARDPLSKR

SEQ ID NO: 15242 - protein, 9 aa, Artificial Sequence
  Description of Artificial Sequence: Synthetic peptide
  Seed: STRDPLSKI (PIK3CA E542K)
SARDPLSKS

SEQ ID NO: 15243 - protein, 9 aa, Artificial Sequence
  Description of Artificial Sequence: Synthetic peptide
  Seed: STRDPLSKI (PIK3CA E542K)
SARDPLSKT

SEQ ID NO: 15244 - protein, 9 aa, Artificial Sequence
  Description of Artificial Sequence: Synthetic peptide
  Seed: STRDPLSKI (PIK3CA E542K)
SCRDPLSKF

SEQ ID NO: 15245 - protein, 9 aa, Artificial Sequence
  Description of Artificial Sequence: Synthetic peptide
  Seed: STRDPLSKI (PIK3CA E542K)
SCRDPLSKH

SEQ ID NO: 15246 - protein, 9 aa, Artificial Sequence
  Description of Artificial Sequence: Synthetic peptide
  Seed: STRDPLSKI (PIK3CA E542K)
SCRDPLSKI

SEQ ID NO: 15247 - protein, 9 aa, Artificial Sequence
  Description of Artificial Sequence: Synthetic peptide
  Seed: STRDPLSKI (PIK3CA E542K)
SCRDPLSKL

SEQ ID NO: 15248 - protein, 9 aa, Artificial Sequence
  Description of Artificial Sequence: Synthetic peptide
  Seed: STRDPLSKI (PIK3CA E542K)
SCRDPLSKM

SEQ ID NO: 15249 - protein, 9 aa, Artificial Sequence
  Description of Artificial Sequence: Synthetic peptide
  Seed: STRDPLSKI (PIK3CA E542K)
SCRDPLSKR

SEQ ID NO: 15250 - protein, 9 aa, Artificial Sequence
  Description of Artificial Sequence: Synthetic peptide
  Seed: STRDPLSKI (PIK3CA E542K)
SCRDPLSKV

SEQ ID NO: 15251 - protein, 9 aa, Artificial Sequence
  Description of Artificial Sequence: Synthetic peptide
  Seed: STRDPLSKI (PIK3CA E542K)
SCRDPLSKW

SEQ ID NO: 15252 - protein, 9 aa, Artificial Sequence
  Description of Artificial Sequence: Synthetic peptide
  Seed: STRDPLSKI (PIK3CA E542K)
SCRDPLSKY

SEQ ID NO: 15253 - protein, 9 aa, Artificial Sequence
  Description of Artificial Sequence: Synthetic peptide
  Seed: STRDPLSKI (PIK3CA E542K)
SDRDPLSKF

SEQ ID NO: 15254 - protein, 9 aa, Artificial Sequence
  Description of Artificial Sequence: Synthetic peptide
  Seed: STRDPLSKI (PIK3CA E542K)
SDRDPLSKH

SEQ ID NO: 15255 - protein, 9 aa, Artificial Sequence
  Description of Artificial Sequence: Synthetic peptide
  Seed: STRDPLSKI (PIK3CA E542K)
SDRDPLSKI

SEQ ID NO: 15256 - protein, 9 aa, Artificial Sequence
  Description of Artificial Sequence: Synthetic peptide
  Seed: STRDPLSKI (PIK3CA E542K)
SDRDPLSKK

SEQ ID NO: 15257 - protein, 9 aa, Artificial Sequence
  Description of Artificial Sequence: Synthetic peptide
  Seed: STRDPLSKI (PIK3CA E542K)
SDRDPLSKL

SEQ ID NO: 15258 - protein, 9 aa, Artificial Sequence
  Description of Artificial Sequence: Synthetic peptide
  Seed: STRDPLSKI (PIK3CA E542K)
SDRDPLSKM

SEQ ID NO: 15259 - protein, 9 aa, Artificial Sequence
  Description of Artificial Sequence: Synthetic peptide
  Seed: STRDPLSKI (PIK3CA E542K)
SDRDPLSKR

SEQ ID NO: 15260 - protein, 9 aa, Artificial Sequence
  Description of Artificial Sequence: Synthetic peptide
  Seed: STRDPLSKI (PIK3CA E542K)
SDRDPLSKV

SEQ ID NO: 15261 - protein, 9 aa, Artificial Sequence
  Description of Artificial Sequence: Synthetic peptide
  Seed: STRDPLSKI (PIK3CA E542K)
SDRDPLSKW

SEQ ID NO: 15262 - protein, 9 aa, Artificial Sequence
  Description of Artificial Sequence: Synthetic peptide
  Seed: STRDPLSKI (PIK3CA E542K)
SDRDPLSKY

SEQ ID NO: 15263 - protein, 9 aa, Artificial Sequence
  Description of Artificial Sequence: Synthetic peptide
  Seed: STRDPLSKI (PIK3CA E542K)
SERDPLSKF

SEQ ID NO: 15264 - protein, 9 aa, Artificial Sequence
  Description of Artificial Sequence: Synthetic peptide
  Seed: STRDPLSKI (PIK3CA E542K)
SERDPLSKH

SEQ ID NO: 15265 - protein, 9 aa, Artificial Sequence
  Description of Artificial Sequence: Synthetic peptide
  Seed: STRDPLSKI (PIK3CA E542K)
SERDPLSKI

SEQ ID NO: 15266 - protein, 9 aa, Artificial Sequence
  Description of Artificial Sequence: Synthetic peptide
  Seed: STRDPLSKI (PIK3CA E542K)
SERDPLSKK

SEQ ID NO: 15267 - protein, 9 aa, Artificial Sequence
  Description of Artificial Sequence: Synthetic peptide
  Seed: STRDPLSKI (PIK3CA E542K)
SERDPLSKL

SEQ ID NO: 15268 - protein, 9 aa, Artificial Sequence
  Description of Artificial Sequence: Synthetic peptide
  Seed: STRDPLSKI (PIK3CA E542K)
SERDPLSKM

SEQ ID NO: 15269 - protein, 9 aa, Artificial Sequence
  Description of Artificial Sequence: Synthetic peptide
  Seed: STRDPLSKI (PIK3CA E542K)
SERDPLSKR

SEQ ID NO: 15270 - protein, 9 aa, Artificial Sequence
  Description of Artificial Sequence: Synthetic peptide
  Seed: STRDPLSKI (PIK3CA E542K)
SERDPLSKV

SEQ ID NO: 15271 - protein, 9 aa, Artificial Sequence
  Description of Artificial Sequence: Synthetic peptide
  Seed: STRDPLSKI (PIK3CA E542K)
SERDPLSKW

SEQ ID NO: 15272 - protein, 9 aa, Artificial Sequence
  Description of Artificial Sequence: Synthetic peptide
  Seed: STRDPLSKI (PIK3CA E542K)
SERDPLSKY

SEQ ID NO: 15273 - protein, 9 aa, Artificial Sequence
  Description of Artificial Sequence: Synthetic peptide
  Seed: STRDPLSKI (PIK3CA E542K)
SFRDPLSKF

SEQ ID NO: 15274 - protein, 9 aa, Artificial Sequence
  Description of Artificial Sequence: Synthetic peptide
  Seed: STRDPLSKI (PIK3CA E542K)
SFRDPLSKH

SEQ ID NO: 15275 - protein, 9 aa, Artificial Sequence
  Description of Artificial Sequence: Synthetic peptide
  Seed: STRDPLSKI (PIK3CA E542K)
SFRDPLSKI

SEQ ID NO: 15276 - protein, 9 aa, Artificial Sequence
  Description of Artificial Sequence: Synthetic peptide
  Seed: STRDPLSKI (PIK3CA E542K)
SFRDPLSKL

SEQ ID NO: 15277 - protein, 9 aa, Artificial Sequence
  Description of Artificial Sequence: Synthetic peptide
  Seed: STRDPLSKI (PIK3CA E542K)
SFRDPLSKM

SEQ ID NO: 15278 - protein, 9 aa, Artificial Sequence
  Description of Artificial Sequence: Synthetic peptide
  Seed: STRDPLSKI (PIK3CA E542K)
SFRDPLSKR

SEQ ID NO: 15279 - protein, 9 aa, Artificial Sequence
  Description of Artificial Sequence: Synthetic peptide
  Seed: STRDPLSKI (PIK3CA E542K)
SFRDPLSKW

SEQ ID NO: 15280 - protein, 9 aa, Artificial Sequence
  Description of Artificial Sequence: Synthetic peptide
  Seed: STRDPLSKI (PIK3CA E542K)
SFRDPLSKY

SEQ ID NO: 15281 - protein, 9 aa, Artificial Sequence
  Description of Artificial Sequence: Synthetic peptide
  Seed: STRDPLSKI (PIK3CA E542K)
SGRDPLSKC

SEQ ID NO: 15282 - protein, 9 aa, Artificial Sequence
  Description of Artificial Sequence: Synthetic peptide
  Seed: STRDPLSKI (PIK3CA E542K)
SGRDPLSKF

SEQ ID NO: 15283 - protein, 9 aa, Artificial Sequence
  Description of Artificial Sequence: Synthetic peptide
  Seed: STRDPLSKI (PIK3CA E542K)
SGRDPLSKH

SEQ ID NO: 15284 - protein, 9 aa, Artificial Sequence
  Description of Artificial Sequence: Synthetic peptide
  Seed: STRDPLSKI (PIK3CA E542K)
SGRDPLSKI

SEQ ID NO: 15285 - protein, 9 aa, Artificial Sequence
  Description of Artificial Sequence: Synthetic peptide
  Seed: STRDPLSKI (PIK3CA E542K)
SGRDPLSKL

SEQ ID NO: 15286 - protein, 9 aa, Artificial Sequence
  Description of Artificial Sequence: Synthetic peptide
  Seed: STRDPLSKI (PIK3CA E542K)
SGRDPLSKM

SEQ ID NO: 15287 - protein, 9 aa, Artificial Sequence
  Description of Artificial Sequence: Synthetic peptide
  Seed: STRDPLSKI (PIK3CA E542K)
SGRDPLSKR

SEQ ID NO: 15288 - protein, 9 aa, Artificial Sequence
  Description of Artificial Sequence: Synthetic peptide
  Seed: STRDPLSKI (PIK3CA E542K)
SGRDPLSKY

SEQ ID NO: 15289 - protein, 9 aa, Artificial Sequence
  Description of Artificial Sequence: Synthetic peptide
  Seed: STRDPLSKI (PIK3CA E542K)
SHRDPLSKF

SEQ ID NO: 15290 - protein, 9 aa, Artificial Sequence
  Description of Artificial Sequence: Synthetic peptide
  Seed: STRDPLSKI (PIK3CA E542K)
SHRDPLSKI

SEQ ID NO: 15291 - protein, 9 aa, Artificial Sequence
  Description of Artificial Sequence: Synthetic peptide
  Seed: STRDPLSKI (PIK3CA E542K)
SHRDPLSKL

SEQ ID NO: 15292 - protein, 9 aa, Artificial Sequence
  Description of Artificial Sequence: Synthetic peptide
  Seed: STRDPLSKI (PIK3CA E542K)
SHRDPLSKM

SEQ ID NO: 15293 - protein, 9 aa, Artificial Sequence
  Description of Artificial Sequence: Synthetic peptide
  Seed: STRDPLSKI (PIK3CA E542K)
SHRDPLSKR

SEQ ID NO: 15294 - protein, 9 aa, Artificial Sequence
  Description of Artificial Sequence: Synthetic peptide
  Seed: STRDPLSKI (PIK3CA E542K)
SHRDPLSKV

SEQ ID NO: 15295 - protein, 9 aa, Artificial Sequence
  Description of Artificial Sequence: Synthetic peptide
  Seed: STRDPLSKI (PIK3CA E542K)
SHRDPLSKW

SEQ ID NO: 15296 - protein, 9 aa, Artificial Sequence
  Description of Artificial Sequence: Synthetic peptide
  Seed: STRDPLSKI (PIK3CA E542K)
SHRDPLSKY

SEQ ID NO: 15297 - protein, 9 aa, Artificial Sequence
  Description of Artificial Sequence: Synthetic peptide
  Seed: STRDPLSKI (PIK3CA E542K)
SIRDPLSKC

SEQ ID NO: 15298 - protein, 9 aa, Artificial Sequence
  Description of Artificial Sequence: Synthetic peptide
  Seed: STRDPLSKI (PIK3CA E542K)
SIRDPLSKH

SEQ ID NO: 15299 - protein, 9 aa, Artificial Sequence
  Description of Artificial Sequence: Synthetic peptide
  Seed: STRDPLSKI (PIK3CA E542K)
SIRDPLSKQ

SEQ ID NO: 15300 - protein, 9 aa, Artificial Sequence
  Description of Artificial Sequence: Synthetic peptide
  Seed: STRDPLSKI (PIK3CA E542K)
SIRDPLSKR

SEQ ID NO: 15301 - protein, 9 aa, Artificial Sequence
  Description of Artificial Sequence: Synthetic peptide
  Seed: STRDPLSKI (PIK3CA E542K)
SIRDPLSKT

SEQ ID NO: 15302 - protein, 9 aa, Artificial Sequence
  Description of Artificial Sequence: Synthetic peptide
  Seed: STRDPLSKI (PIK3CA E542K)
SKRDPLSKF

SEQ ID NO: 15303 - protein, 9 aa, Artificial Sequence
  Description of Artificial Sequence: Synthetic peptide
  Seed: STRDPLSKI (PIK3CA E542K)
SKRDPLSKI

SEQ ID NO: 15304 - protein, 9 aa, Artificial Sequence
  Description of Artificial Sequence: Synthetic peptide
  Seed: STRDPLSKI (PIK3CA E542K)
SKRDPLSKK

SEQ ID NO: 15305 - protein, 9 aa, Artificial Sequence
  Description of Artificial Sequence: Synthetic peptide
  Seed: STRDPLSKI (PIK3CA E542K)
SKRDPLSKL

SEQ ID NO: 15306 - protein, 9 aa, Artificial Sequence
  Description of Artificial Sequence: Synthetic peptide
  Seed: STRDPLSKI (PIK3CA E542K)
SKRDPLSKM

SEQ ID NO: 15307 - protein, 9 aa, Artificial Sequence
  Description of Artificial Sequence: Synthetic peptide
  Seed: STRDPLSKI (PIK3CA E542K)
SKRDPLSKV

SEQ ID NO: 15308 - protein, 9 aa, Artificial Sequence
  Description of Artificial Sequence: Synthetic peptide
  Seed: STRDPLSKI (PIK3CA E542K)
SKRDPLSKW

SEQ ID NO: 15309 - protein, 9 aa, Artificial Sequence
  Description of Artificial Sequence: Synthetic peptide
  Seed: STRDPLSKI (PIK3CA E542K)
SKRDPLSKY

SEQ ID NO: 15310 - protein, 9 aa, Artificial Sequence
  Description of Artificial Sequence: Synthetic peptide
  Seed: STRDPLSKI (PIK3CA E542K)
SLRDPLSKC

SEQ ID NO: 15311 - protein, 9 aa, Artificial Sequence
  Description of Artificial Sequence: Synthetic peptide
  Seed: STRDPLSKI (PIK3CA E542K)
SLRDPLSKH

SEQ ID NO: 15312 - protein, 9 aa, Artificial Sequence
  Description of Artificial Sequence: Synthetic peptide
  Seed: STRDPLSKI (PIK3CA E542K)
SLRDPLSKL

SEQ ID NO: 15313 - protein, 9 aa, Artificial Sequence
  Description of Artificial Sequence: Synthetic peptide
  Seed: STRDPLSKI (PIK3CA E542K)
SLRDPLSKM

SEQ ID NO: 15314 - protein, 9 aa, Artificial Sequence
  Description of Artificial Sequence: Synthetic peptide
  Seed: STRDPLSKI (PIK3CA E542K)
SLRDPLSKR

SEQ ID NO: 15315 - protein, 9 aa, Artificial Sequence
  Description of Artificial Sequence: Synthetic peptide
  Seed: STRDPLSKI (PIK3CA E542K)
SLRDPLSKT

SEQ ID NO: 15316 - protein, 9 aa, Artificial Sequence
  Description of Artificial Sequence: Synthetic peptide
  Seed: STRDPLSKI (PIK3CA E542K)
SLRDPLSKV

SEQ ID NO: 15317 - protein, 9 aa, Artificial Sequence
  Description of Artificial Sequence: Synthetic peptide
  Seed: STRDPLSKI (PIK3CA E542K)
SMRDPLSKC

SEQ ID NO: 15318 - protein, 9 aa, Artificial Sequence
  Description of Artificial Sequence: Synthetic peptide
  Seed: STRDPLSKI (PIK3CA E542K)
SMRDPLSKH

SEQ ID NO: 15319 - protein, 9 aa, Artificial Sequence
  Description of Artificial Sequence: Synthetic peptide
  Seed: STRDPLSKI (PIK3CA E542K)
SMRDPLSKQ

SEQ ID NO: 15320 - protein, 9 aa, Artificial Sequence
  Description of Artificial Sequence: Synthetic peptide
  Seed: STRDPLSKI (PIK3CA E542K)
SMRDPLSKT

SEQ ID NO: 15321 - protein, 9 aa, Artificial Sequence
  Description of Artificial Sequence: Synthetic peptide
  Seed: STRDPLSKI (PIK3CA E542K)
SNRDPLSKF

SEQ ID NO: 15322 - protein, 9 aa, Artificial Sequence
  Description of Artificial Sequence: Synthetic peptide
  Seed: STRDPLSKI (PIK3CA E542K)
SNRDPLSKH

SEQ ID NO: 15323 - protein, 9 aa, Artificial Sequence
  Description of Artificial Sequence: Synthetic peptide
  Seed: STRDPLSKI (PIK3CA E542K)
SNRDPLSKI

SEQ ID NO: 15324 - protein, 9 aa, Artificial Sequence
  Description of Artificial Sequence: Synthetic peptide
  Seed: STRDPLSKI (PIK3CA E542K)
SNRDPLSKL

SEQ ID NO: 15325 - protein, 9 aa, Artificial Sequence
  Description of Artificial Sequence: Synthetic peptide
  Seed: STRDPLSKI (PIK3CA E542K)
SNRDPLSKM

SEQ ID NO: 15326 - protein, 9 aa, Artificial Sequence
  Description of Artificial Sequence: Synthetic peptide
  Seed: STRDPLSKI (PIK3CA E542K)
SNRDPLSKR

SEQ ID NO: 15327 - protein, 9 aa, Artificial Sequence
  Description of Artificial Sequence: Synthetic peptide
  Seed: STRDPLSKI (PIK3CA E542K)
SNRDPLSKV

SEQ ID NO: 15328 - protein, 9 aa, Artificial Sequence
  Description of Artificial Sequence: Synthetic peptide
  Seed: STRDPLSKI (PIK3CA E542K)
SNRDPLSKW

SEQ ID NO: 15329 - protein, 9 aa, Artificial Sequence
  Description of Artificial Sequence: Synthetic peptide
  Seed: STRDPLSKI (PIK3CA E542K)
SNRDPLSKY

SEQ ID NO: 15330 - protein, 9 aa, Artificial Sequence
  Description of Artificial Sequence: Synthetic peptide
  Seed: STRDPLSKI (PIK3CA E542K)
SPRDPLSKA

SEQ ID NO: 15331 - protein, 9 aa, Artificial Sequence
  Description of Artificial Sequence: Synthetic peptide
  Seed: STRDPLSKI (PIK3CA E542K)
SPRDPLSKF

SEQ ID NO: 15332 - protein, 9 aa, Artificial Sequence
  Description of Artificial Sequence: Synthetic peptide
  Seed: STRDPLSKI (PIK3CA E542K)
SPRDPLSKH

SEQ ID NO: 15333 - protein, 9 aa, Artificial Sequence
  Description of Artificial Sequence: Synthetic peptide
  Seed: STRDPLSKI (PIK3CA E542K)
SPRDPLSKI

SEQ ID NO: 15334 - protein, 9 aa, Artificial Sequence
  Description of Artificial Sequence: Synthetic peptide
  Seed: STRDPLSKI (PIK3CA E542K)
SPRDPLSKK

SEQ ID NO: 15335 - protein, 9 aa, Artificial Sequence
  Description of Artificial Sequence: Synthetic peptide
  Seed: STRDPLSKI (PIK3CA E542K)
SPRDPLSKL

SEQ ID NO: 15336 - protein, 9 aa, Artificial Sequence
  Description of Artificial Sequence: Synthetic peptide
  Seed: STRDPLSKI (PIK3CA E542K)
SPRDPLSKM

SEQ ID NO: 15337 - protein, 9 aa, Artificial Sequence
  Description of Artificial Sequence: Synthetic peptide
  Seed: STRDPLSKI (PIK3CA E542K)
SPRDPLSKR

SEQ ID NO: 15338 - protein, 9 aa, Artificial Sequence
  Description of Artificial Sequence: Synthetic peptide
  Seed: STRDPLSKI (PIK3CA E542K)
SPRDPLSKV

SEQ ID NO: 15339 - protein, 9 aa, Artificial Sequence
  Description of Artificial Sequence: Synthetic peptide
  Seed: STRDPLSKI (PIK3CA E542K)
SPRDPLSKW

SEQ ID NO: 15340 - protein, 9 aa, Artificial Sequence
  Description of Artificial Sequence: Synthetic peptide
  Seed: STRDPLSKI (PIK3CA E542K)
SPRDPLSKY

SEQ ID NO: 15341 - protein, 9 aa, Artificial Sequence
  Description of Artificial Sequence: Synthetic peptide
  Seed: STRDPLSKI (PIK3CA E542K)
SQRDPLSKC

SEQ ID NO: 15342 - protein, 9 aa, Artificial Sequence
  Description of Artificial Sequence: Synthetic peptide
  Seed: STRDPLSKI (PIK3CA E542K)
SQRDPLSKF

SEQ ID NO: 15343 - protein, 9 aa, Artificial Sequence
  Description of Artificial Sequence: Synthetic peptide
  Seed: STRDPLSKI (PIK3CA E542K)
SQRDPLSKH

SEQ ID NO: 15344 - protein, 9 aa, Artificial Sequence
  Description of Artificial Sequence: Synthetic peptide
  Seed: STRDPLSKI (PIK3CA E542K)
SQRDPLSKI

SEQ ID NO: 15345 - protein, 9 aa, Artificial Sequence
  Description of Artificial Sequence: Synthetic peptide
  Seed: STRDPLSKI (PIK3CA E542K)
SQRDPLSKL

SEQ ID NO: 15346 - protein, 9 aa, Artificial Sequence
  Description of Artificial Sequence: Synthetic peptide
  Seed: STRDPLSKI (PIK3CA E542K)
SQRDPLSKQ

SEQ ID NO: 15347 - protein, 9 aa, Artificial Sequence
  Description of Artificial Sequence: Synthetic peptide
  Seed: STRDPLSKI (PIK3CA E542K)
SQRDPLSKR

SEQ ID NO: 15348 - protein, 9 aa, Artificial Sequence
  Description of Artificial Sequence: Synthetic peptide
  Seed: STRDPLSKI (PIK3CA E542K)
SQRDPLSKT

SEQ ID NO: 15349 - protein, 9 aa, Artificial Sequence
  Description of Artificial Sequence: Synthetic peptide
  Seed: STRDPLSKI (PIK3CA E542K)
SQRDPLSKY

SEQ ID NO: 15350 - protein, 9 aa, Artificial Sequence
  Description of Artificial Sequence: Synthetic peptide
  Seed: STRDPLSKI (PIK3CA E542K)
SRRDPLSKA

SEQ ID NO: 15351 - protein, 9 aa, Artificial Sequence
  Description of Artificial Sequence: Synthetic peptide
  Seed: STRDPLSKI (PIK3CA E542K)
SRRDPLSKC

SEQ ID NO: 15352 - protein, 9 aa, Artificial Sequence
  Description of Artificial Sequence: Synthetic peptide
  Seed: STRDPLSKI (PIK3CA E542K)
SRRDPLSKF

SEQ ID NO: 15353 - protein, 9 aa, Artificial Sequence
  Description of Artificial Sequence: Synthetic peptide
  Seed: STRDPLSKI (PIK3CA E542K)
SRRDPLSKH

SEQ ID NO: 15354 - protein, 9 aa, Artificial Sequence
  Description of Artificial Sequence: Synthetic peptide
  Seed: STRDPLSKI (PIK3CA E542K)
SRRDPLSKI

SEQ ID NO: 15355 - protein, 9 aa, Artificial Sequence
  Description of Artificial Sequence: Synthetic peptide
  Seed: STRDPLSKI (PIK3CA E542K)
SRRDPLSKK

SEQ ID NO: 15356 - protein, 9 aa, Artificial Sequence
  Description of Artificial Sequence: Synthetic peptide
  Seed: STRDPLSKI (PIK3CA E542K)
SRRDPLSKL

SEQ ID NO: 15357 - protein, 9 aa, Artificial Sequence
  Description of Artificial Sequence: Synthetic peptide
  Seed: STRDPLSKI (PIK3CA E542K)
SRRDPLSKM

SEQ ID NO: 15358 - protein, 9 aa, Artificial Sequence
  Description of Artificial Sequence: Synthetic peptide
  Seed: STRDPLSKI (PIK3CA E542K)
SRRDPLSKR

SEQ ID NO: 15359 - protein, 9 aa, Artificial Sequence
  Description of Artificial Sequence: Synthetic peptide
  Seed: STRDPLSKI (PIK3CA E542K)
SRRDPLSKV

SEQ ID NO: 15360 - protein, 9 aa, Artificial Sequence
  Description of Artificial Sequence: Synthetic peptide
  Seed: STRDPLSKI (PIK3CA E542K)
SRRDPLSKW

SEQ ID NO: 15361 - protein, 9 aa, Artificial Sequence
  Description of Artificial Sequence: Synthetic peptide
  Seed: STRDPLSKI (PIK3CA E542K)
SRRDPLSKY

SEQ ID NO: 15362 - protein, 9 aa, Artificial Sequence
  Description of Artificial Sequence: Synthetic peptide
  Seed: STRDPLSKI (PIK3CA E542K)
SSRDPLSKH

SEQ ID NO: 15363 - protein, 9 aa, Artificial Sequence
  Description of Artificial Sequence: Synthetic peptide
  Seed: STRDPLSKI (PIK3CA E542K)
SSRDPLSKQ

SEQ ID NO: 15364 - protein, 9 aa, Artificial Sequence
  Description of Artificial Sequence: Synthetic peptide
  Seed: STRDPLSKI (PIK3CA E542K)
SVRDPLSKC

SEQ ID NO: 15365 - protein, 9 aa, Artificial Sequence
  Description of Artificial Sequence: Synthetic peptide
  Seed: STRDPLSKI (PIK3CA E542K)
SVRDPLSKH

SEQ ID NO: 15366 - protein, 9 aa, Artificial Sequence
  Description of Artificial Sequence: Synthetic peptide
  Seed: STRDPLSKI (PIK3CA E542K)
SVRDPLSKP

SEQ ID NO: 15367 - protein, 9 aa, Artificial Sequence
  Description of Artificial Sequence: Synthetic peptide
  Seed: STRDPLSKI (PIK3CA E542K)
SVRDPLSKQ

SEQ ID NO: 15368 - protein, 9 aa, Artificial Sequence
  Description of Artificial Sequence: Synthetic peptide
  Seed: STRDPLSKI (PIK3CA E542K)
SWRDPLSKF

SEQ ID NO: 15369 - protein, 9 aa, Artificial Sequence
  Description of Artificial Sequence: Synthetic peptide
  Seed: STRDPLSKI (PIK3CA E542K)
SWRDPLSKI

SEQ ID NO: 15370 - protein, 9 aa, Artificial Sequence
  Description of Artificial Sequence: Synthetic peptide
  Seed: STRDPLSKI (PIK3CA E542K)
SWRDPLSKL

SEQ ID NO: 15371 - protein, 9 aa, Artificial Sequence
  Description of Artificial Sequence: Synthetic peptide
  Seed: STRDPLSKI (PIK3CA E542K)
SWRDPLSKM

SEQ ID NO: 15372 - protein, 9 aa, Artificial Sequence
  Description of Artificial Sequence: Synthetic peptide
  Seed: STRDPLSKI (PIK3CA E542K)
SWRDPLSKR

SEQ ID NO: 15373 - protein, 9 aa, Artificial Sequence
  Description of Artificial Sequence: Synthetic peptide
  Seed: STRDPLSKI (PIK3CA E542K)
SWRDPLSKW

SEQ ID NO: 15374 - protein, 9 aa, Artificial Sequence
  Description of Artificial Sequence: Synthetic peptide
  Seed: STRDPLSKI (PIK3CA E542K)
SWRDPLSKY

SEQ ID NO: 15375 - protein, 9 aa, Artificial Sequence
  Description of Artificial Sequence: Synthetic peptide
  Seed: STRDPLSKI (PIK3CA E542K)
SYRDPLSKF

SEQ ID NO: 15376 - protein, 9 aa, Artificial Sequence
  Description of Artificial Sequence: Synthetic peptide
  Seed: STRDPLSKI (PIK3CA E542K)
SYRDPLSKH

SEQ ID NO: 15377 - protein, 9 aa, Artificial Sequence
  Description of Artificial Sequence: Synthetic peptide
  Seed: STRDPLSKI (PIK3CA E542K)
SYRDPLSKL

SEQ ID NO: 15378 - protein, 9 aa, Artificial Sequence
  Description of Artificial Sequence: Synthetic peptide
  Seed: STRDPLSKI (PIK3CA E542K)
SYRDPLSKM

SEQ ID NO: 15379 - protein, 9 aa, Artificial Sequence
  Description of Artificial Sequence: Synthetic peptide
  Seed: STRDPLSKI (PIK3CA E542K)
SYRDPLSKW

SEQ ID NO: 15380 - protein, 9 aa, Artificial Sequence
  Description of Artificial Sequence: Synthetic peptide
  Seed: STRDPLSKI (PIK3CA E542K)
SYRDPLSKY

SEQ ID NO: 15381 - protein, 8 aa, Artificial Sequence
  Description of Artificial Sequence: Synthetic peptide
  Seed: TRDPLSKI (PIK3CA E542K)
TADPLSKF

SEQ ID NO: 15382 - protein, 8 aa, Artificial Sequence
  Description of Artificial Sequence: Synthetic peptide
  Seed: TRDPLSKI (PIK3CA E542K)
TADPLSKI

SEQ ID NO: 15383 - protein, 9 aa, Artificial Sequence
  Description of Artificial Sequence: Synthetic peptide
  Seed: TRDPLSKIT (PIK3CA E542K)
TADPLSKIA

SEQ ID NO: 15384 - protein, 9 aa, Artificial Sequence
  Description of Artificial Sequence: Synthetic peptide
  Seed: TRDPLSKIT (PIK3CA E542K)
TADPLSKIC

SEQ ID NO: 15385 - protein, 9 aa, Artificial Sequence
  Description of Artificial Sequence: Synthetic peptide
  Seed: TRDPLSKIT (PIK3CA E542K)
TADPLSKIF

SEQ ID NO: 15386 - protein, 9 aa, Artificial Sequence
  Description of Artificial Sequence: Synthetic peptide
  Seed: TRDPLSKIT (PIK3CA E542K)
TADPLSKII

SEQ ID NO: 15387 - protein, 9 aa, Artificial Sequence
  Description of Artificial Sequence: Synthetic peptide
  Seed: TRDPLSKIT (PIK3CA E542K)
TADPLSKIL

SEQ ID NO: 15388 - protein, 9 aa, Artificial Sequence
  Description of Artificial Sequence: Synthetic peptide
  Seed: TRDPLSKIT (PIK3CA E542K)
TADPLSKIM

SEQ ID NO: 15389 - protein, 9 aa, Artificial Sequence
  Description of Artificial Sequence: Synthetic peptide
  Seed: TRDPLSKIT (PIK3CA E542K)
TADPLSKIV

SEQ ID NO: 15390 - protein, 9 aa, Artificial Sequence
  Description of Artificial Sequence: Synthetic peptide
  Seed: TRDPLSKIT (PIK3CA E542K)
TADPLSKIY

SEQ ID NO: 15391 - protein, 8 aa, Artificial Sequence
  Description of Artificial Sequence: Synthetic peptide
  Seed: TRDPLSKI (PIK3CA E542K)
TADPLSKL

SEQ ID NO: 15392 - protein, 8 aa, Artificial Sequence
  Description of Artificial Sequence: Synthetic peptide
  Seed: TRDPLSKI (PIK3CA E542K)
TADPLSKM

SEQ ID NO: 15393 - protein, 8 aa, Artificial Sequence
  Description of Artificial Sequence: Synthetic peptide
  Seed: TRDPLSKI (PIK3CA E542K)
TADPLSKV

SEQ ID NO: 15394 - protein, 8 aa, Artificial Sequence
  Description of Artificial Sequence: Synthetic peptide
  Seed: TRDPLSKI (PIK3CA E542K)
TADPLSKY

SEQ ID NO: 15395 - protein, 8 aa, Artificial Sequence
  Description of Artificial Sequence: Synthetic peptide
  Seed: TRDPLSKI (PIK3CA E542K)
TCDPLSKF

SEQ ID NO: 15396 - protein, 8 aa, Artificial Sequence
  Description of Artificial Sequence: Synthetic peptide
  Seed: TRDPLSKI (PIK3CA E542K)
TCDPLSKI

SEQ ID NO: 15397 - protein, 9 aa, Artificial Sequence
  Description of Artificial Sequence: Synthetic peptide
  Seed: TRDPLSKIT (PIK3CA E542K)
TCDPLSKIF

SEQ ID NO: 15398 - protein, 9 aa, Artificial Sequence
  Description of Artificial Sequence: Synthetic peptide
  Seed: TRDPLSKIT (PIK3CA E542K)
TCDPLSKII

SEQ ID NO: 15399 - protein, 9 aa, Artificial Sequence
  Description of Artificial Sequence: Synthetic peptide
  Seed: TRDPLSKIT (PIK3CA E542K)
TCDPLSKIL

SEQ ID NO: 15400 - protein, 9 aa, Artificial Sequence
  Description of Artificial Sequence: Synthetic peptide
  Seed: TRDPLSKIT (PIK3CA E542K)
TCDPLSKIM

SEQ ID NO: 15401 - protein, 9 aa, Artificial Sequence
  Description of Artificial Sequence: Synthetic peptide
  Seed: TRDPLSKIT (PIK3CA E542K)
TCDPLSKIV

SEQ ID NO: 15402 - protein, 8 aa, Artificial Sequence
  Description of Artificial Sequence: Synthetic peptide
  Seed: TRDPLSKI (PIK3CA E542K)
TCDPLSKL

SEQ ID NO: 15403 - protein, 8 aa, Artificial Sequence
  Description of Artificial Sequence: Synthetic peptide
  Seed: TRDPLSKI (PIK3CA E542K)
TCDPLSKM

SEQ ID NO: 15404 - protein, 8 aa, Artificial Sequence
  Description of Artificial Sequence: Synthetic peptide
  Seed: TRDPLSKI (PIK3CA E542K)
TDDPLSKF

SEQ ID NO: 15405 - protein, 8 aa, Artificial Sequence
  Description of Artificial Sequence: Synthetic peptide
  Seed: TRDPLSKI (PIK3CA E542K)
TDDPLSKI

SEQ ID NO: 15406 - protein, 9 aa, Artificial Sequence
  Description of Artificial Sequence: Synthetic peptide
  Seed: TRDPLSKIT (PIK3CA E542K)
TDDPLSKIF

SEQ ID NO: 15407 - protein, 9 aa, Artificial Sequence
  Description of Artificial Sequence: Synthetic peptide
  Seed: TRDPLSKIT (PIK3CA E542K)
TDDPLSKII

SEQ ID NO: 15408 - protein, 9 aa, Artificial Sequence
  Description of Artificial Sequence: Synthetic peptide
  Seed: TRDPLSKIT (PIK3CA E542K)
TDDPLSKIL

SEQ ID NO: 15409 - protein, 9 aa, Artificial Sequence
  Description of Artificial Sequence: Synthetic peptide
  Seed: TRDPLSKIT (PIK3CA E542K)
TDDPLSKIM

SEQ ID NO: 15410 - protein, 9 aa, Artificial Sequence
  Description of Artificial Sequence: Synthetic peptide
  Seed: TRDPLSKIT (PIK3CA E542K)
TDDPLSKIV

SEQ ID NO: 15411 - protein, 8 aa, Artificial Sequence
  Description of Artificial Sequence: Synthetic peptide
  Seed: TRDPLSKI (PIK3CA E542K)
TDDPLSKL

SEQ ID NO: 15412 - protein, 8 aa, Artificial Sequence
  Description of Artificial Sequence: Synthetic peptide
  Seed: TRDPLSKI (PIK3CA E542K)
TDDPLSKM

SEQ ID NO: 15413 - protein, 8 aa, Artificial Sequence
  Description of Artificial Sequence: Synthetic peptide
  Seed: TRDPLSKI (PIK3CA E542K)
TEDPLSKF

SEQ ID NO: 15414 - protein, 8 aa, Artificial Sequence
  Description of Artificial Sequence: Synthetic peptide
  Seed: TRDPLSKI (PIK3CA E542K)
TEDPLSKI

SEQ ID NO: 15415 - protein, 9 aa, Artificial Sequence
  Description of Artificial Sequence: Synthetic peptide
  Seed: TRDPLSKIT (PIK3CA E542K)
TEDPLSKIF

SEQ ID NO: 15416 - protein, 9 aa, Artificial Sequence
  Description of Artificial Sequence: Synthetic peptide
  Seed: TRDPLSKIT (PIK3CA E542K)
TEDPLSKII

SEQ ID NO: 15417 - protein, 9 aa, Artificial Sequence
  Description of Artificial Sequence: Synthetic peptide
  Seed: TRDPLSKIT (PIK3CA E542K)
TEDPLSKIL

SEQ ID NO: 15418 - protein, 9 aa, Artificial Sequence
  Description of Artificial Sequence: Synthetic peptide
  Seed: TRDPLSKIT (PIK3CA E542K)
TEDPLSKIM

SEQ ID NO: 15419 - protein, 9 aa, Artificial Sequence
  Description of Artificial Sequence: Synthetic peptide
  Seed: TRDPLSKIT (PIK3CA E542K)
TEDPLSKIV

SEQ ID NO: 15420 - protein, 8 aa, Artificial Sequence
  Description of Artificial Sequence: Synthetic peptide
  Seed: TRDPLSKI (PIK3CA E542K)
TEDPLSKL

SEQ ID NO: 15421 - protein, 8 aa, Artificial Sequence
  Description of Artificial Sequence: Synthetic peptide
  Seed: TRDPLSKI (PIK3CA E542K)
TEDPLSKM

SEQ ID NO: 15422 - protein, 8 aa, Artificial Sequence
  Description of Artificial Sequence: Synthetic peptide
  Seed: TRDPLSKI (PIK3CA E542K)
TEDPLSKV

SEQ ID NO: 15423 - protein, 8 aa, Artificial Sequence
  Description of Artificial Sequence: Synthetic peptide
  Seed: TRDPLSKI (PIK3CA E542K)
TFDPLSKC

SEQ ID NO: 15424 - protein, 8 aa, Artificial Sequence
  Description of Artificial Sequence: Synthetic peptide
  Seed: TRDPLSKI (PIK3CA E542K)
TFDPLSKF

SEQ ID NO: 15425 - protein, 8 aa, Artificial Sequence
  Description of Artificial Sequence: Synthetic peptide
  Seed: TRDPLSKI (PIK3CA E542K)
TFDPLSKI

SEQ ID NO: 15426 - protein, 9 aa, Artificial Sequence
  Description of Artificial Sequence: Synthetic peptide
  Seed: TRDPLSKIT (PIK3CA E542K)
TFDPLSKIA

SEQ ID NO: 15427 - protein, 9 aa, Artificial Sequence
  Description of Artificial Sequence: Synthetic peptide
  Seed: TRDPLSKIT (PIK3CA E542K)
TFDPLSKIC

SEQ ID NO: 15428 - protein, 9 aa, Artificial Sequence
  Description of Artificial Sequence: Synthetic peptide
  Seed: TRDPLSKIT (PIK3CA E542K)
TFDPLSKIF

SEQ ID NO: 15429 - protein, 9 aa, Artificial Sequence
  Description of Artificial Sequence: Synthetic peptide
  Seed: TRDPLSKIT (PIK3CA E542K)
TFDPLSKII

SEQ ID NO: 15430 - protein, 9 aa, Artificial Sequence
  Description of Artificial Sequence: Synthetic peptide
  Seed: TRDPLSKIT (PIK3CA E542K)
TFDPLSKIL

SEQ ID NO: 15431 - protein, 9 aa, Artificial Sequence
  Description of Artificial Sequence: Synthetic peptide
  Seed: TRDPLSKIT (PIK3CA E542K)
TFDPLSKIM

SEQ ID NO: 15432 - protein, 9 aa, Artificial Sequence
  Description of Artificial Sequence: Synthetic peptide
  Seed: TRDPLSKIT (PIK3CA E542K)
TFDPLSKIT

SEQ ID NO: 15433 - protein, 9 aa, Artificial Sequence
  Description of Artificial Sequence: Synthetic peptide
  Seed: TRDPLSKIT (PIK3CA E542K)
TFDPLSKIV

SEQ ID NO: 15434 - protein, 9 aa, Artificial Sequence
  Description of Artificial Sequence: Synthetic peptide
  Seed: TRDPLSKIT (PIK3CA E542K)
TFDPLSKIW

SEQ ID NO: 15435 - protein, 9 aa, Artificial Sequence
  Description of Artificial Sequence: Synthetic peptide
  Seed: TRDPLSKIT (PIK3CA E542K)
TFDPLSKIY

SEQ ID NO: 15436 - protein, 8 aa, Artificial Sequence
  Description of Artificial Sequence: Synthetic peptide
  Seed: TRDPLSKI (PIK3CA E542K)
TFDPLSKL

SEQ ID NO: 15437 - protein, 8 aa, Artificial Sequence
  Description of Artificial Sequence: Synthetic peptide
  Seed: TRDPLSKI (PIK3CA E542K)
TFDPLSKM

SEQ ID NO: 15438 - protein, 8 aa, Artificial Sequence
  Description of Artificial Sequence: Synthetic peptide
  Seed: TRDPLSKI (PIK3CA E542K)
TFDPLSKV

SEQ ID NO: 15439 - protein, 8 aa, Artificial Sequence
  Description of Artificial Sequence: Synthetic peptide
  Seed: TRDPLSKI (PIK3CA E542K)
TFDPLSKW

SEQ ID NO: 15440 - protein, 8 aa, Artificial Sequence
  Description of Artificial Sequence: Synthetic peptide
  Seed: TRDPLSKI (PIK3CA E542K)
TFDPLSKY

SEQ ID NO: 15441 - protein, 8 aa, Artificial Sequence
  Description of Artificial Sequence: Synthetic peptide
  Seed: TRDPLSKI (PIK3CA E542K)
TGDPLSKF

SEQ ID NO: 15442 - protein, 8 aa, Artificial Sequence
  Description of Artificial Sequence: Synthetic peptide
  Seed: TRDPLSKI (PIK3CA E542K)
TGDPLSKI

SEQ ID NO: 15443 - protein, 9 aa, Artificial Sequence
  Description of Artificial Sequence: Synthetic peptide
  Seed: TRDPLSKIT (PIK3CA E542K)
TGDPLSKIF

SEQ ID NO: 15444 - protein, 9 aa, Artificial Sequence
  Description of Artificial Sequence: Synthetic peptide
  Seed: TRDPLSKIT (PIK3CA E542K)
TGDPLSKII

SEQ ID NO: 15445 - protein, 9 aa, Artificial Sequence
  Description of Artificial Sequence: Synthetic peptide
  Seed: TRDPLSKIT (PIK3CA E542K)
TGDPLSKIL

SEQ ID NO: 15446 - protein, 9 aa, Artificial Sequence
  Description of Artificial Sequence: Synthetic peptide
  Seed: TRDPLSKIT (PIK3CA E542K)
TGDPLSKIM

SEQ ID NO: 15447 - protein, 9 aa, Artificial Sequence
  Description of Artificial Sequence: Synthetic peptide
  Seed: TRDPLSKIT (PIK3CA E542K)
TGDPLSKIV

SEQ ID NO: 15448 - protein, 8 aa, Artificial Sequence
  Description of Artificial Sequence: Synthetic peptide
  Seed: TRDPLSKI (PIK3CA E542K)
TGDPLSKL

SEQ ID NO: 15449 - protein, 8 aa, Artificial Sequence
  Description of Artificial Sequence: Synthetic peptide
  Seed: TRDPLSKI (PIK3CA E542K)
TGDPLSKM

SEQ ID NO: 15450 - protein, 8 aa, Artificial Sequence
  Description of Artificial Sequence: Synthetic peptide
  Seed: TRDPLSKI (PIK3CA E542K)
TGDPLSKV

SEQ ID NO: 15451 - protein, 8 aa, Artificial Sequence
  Description of Artificial Sequence: Synthetic peptide
  Seed: TRDPLSKI (PIK3CA E542K)
THDPLSKF

SEQ ID NO: 15452 - protein, 8 aa, Artificial Sequence
  Description of Artificial Sequence: Synthetic peptide
  Seed: TRDPLSKI (PIK3CA E542K)
THDPLSKI

SEQ ID NO: 15453 - protein, 9 aa, Artificial Sequence
  Description of Artificial Sequence: Synthetic peptide
  Seed: TRDPLSKIT (PIK3CA E542K)
THDPLSKIA

SEQ ID NO: 15454 - protein, 9 aa, Artificial Sequence
  Description of Artificial Sequence: Synthetic peptide
  Seed: TRDPLSKIT (PIK3CA E542K)
THDPLSKIF

SEQ ID NO: 15455 - protein, 9 aa, Artificial Sequence
  Description of Artificial Sequence: Synthetic peptide
  Seed: TRDPLSKIT (PIK3CA E542K)
THDPLSKII

SEQ ID NO: 15456 - protein, 9 aa, Artificial Sequence
  Description of Artificial Sequence: Synthetic peptide
  Seed: TRDPLSKIT (PIK3CA E542K)
THDPLSKIL

SEQ ID NO: 15457 - protein, 9 aa, Artificial Sequence
  Description of Artificial Sequence: Synthetic peptide
  Seed: TRDPLSKIT (PIK3CA E542K)
THDPLSKIM

SEQ ID NO: 15458 - protein, 9 aa, Artificial Sequence
  Description of Artificial Sequence: Synthetic peptide
  Seed: TRDPLSKIT (PIK3CA E542K)
THDPLSKIV

SEQ ID NO: 15459 - protein, 9 aa, Artificial Sequence
  Description of Artificial Sequence: Synthetic peptide
  Seed: TRDPLSKIT (PIK3CA E542K)
THDPLSKIY

SEQ ID NO: 15460 - protein, 8 aa, Artificial Sequence
  Description of Artificial Sequence: Synthetic peptide
  Seed: TRDPLSKI (PIK3CA E542K)
THDPLSKL

SEQ ID NO: 15461 - protein, 8 aa, Artificial Sequence
  Description of Artificial Sequence: Synthetic peptide
  Seed: TRDPLSKI (PIK3CA E542K)
THDPLSKM

SEQ ID NO: 15462 - protein, 8 aa, Artificial Sequence
  Description of Artificial Sequence: Synthetic peptide
  Seed: TRDPLSKI (PIK3CA E542K)
THDPLSKV

SEQ ID NO: 15463 - protein, 8 aa, Artificial Sequence
  Description of Artificial Sequence: Synthetic peptide
  Seed: TRDPLSKI (PIK3CA E542K)
THDPLSKY

SEQ ID NO: 15464 - protein, 8 aa, Artificial Sequence
  Description of Artificial Sequence: Synthetic peptide
  Seed: TRDPLSKI (PIK3CA E542K)
TIDPLSKF

SEQ ID NO: 15465 - protein, 8 aa, Artificial Sequence
  Description of Artificial Sequence: Synthetic peptide
  Seed: TRDPLSKI (PIK3CA E542K)
TIDPLSKI

SEQ ID NO: 15466 - protein, 9 aa, Artificial Sequence
  Description of Artificial Sequence: Synthetic peptide
  Seed: TRDPLSKIT (PIK3CA E542K)
TIDPLSKIC

SEQ ID NO: 15467 - protein, 9 aa, Artificial Sequence
  Description of Artificial Sequence: Synthetic peptide
  Seed: TRDPLSKIT (PIK3CA E542K)
TIDPLSKIF

SEQ ID NO: 15468 - protein, 9 aa, Artificial Sequence
  Description of Artificial Sequence: Synthetic peptide
  Seed: TRDPLSKIT (PIK3CA E542K)
TIDPLSKII

SEQ ID NO: 15469 - protein, 9 aa, Artificial Sequence
  Description of Artificial Sequence: Synthetic peptide
  Seed: TRDPLSKIT (PIK3CA E542K)
TIDPLSKIL

SEQ ID NO: 15470 - protein, 9 aa, Artificial Sequence
  Description of Artificial Sequence: Synthetic peptide
  Seed: TRDPLSKIT (PIK3CA E542K)
TIDPLSKIM

SEQ ID NO: 15471 - protein, 9 aa, Artificial Sequence
  Description of Artificial Sequence: Synthetic peptide
  Seed: TRDPLSKIT (PIK3CA E542K)
TIDPLSKIV

SEQ ID NO: 15472 - protein, 8 aa, Artificial Sequence
  Description of Artificial Sequence: Synthetic peptide
  Seed: TRDPLSKI (PIK3CA E542K)
TIDPLSKL

SEQ ID NO: 15473 - protein, 8 aa, Artificial Sequence
  Description of Artificial Sequence: Synthetic peptide
  Seed: TRDPLSKI (PIK3CA E542K)
TIDPLSKM

SEQ ID NO: 15474 - protein, 8 aa, Artificial Sequence
  Description of Artificial Sequence: Synthetic peptide
  Seed: TRDPLSKI (PIK3CA E542K)
TIDPLSKV

SEQ ID NO: 15475 - protein, 8 aa, Artificial Sequence
  Description of Artificial Sequence: Synthetic peptide
  Seed: TRDPLSKI (PIK3CA E542K)
TKDPLSKF

SEQ ID NO: 15476 - protein, 8 aa, Artificial Sequence
  Description of Artificial Sequence: Synthetic peptide
  Seed: TRDPLSKI (PIK3CA E542K)
TKDPLSKI

SEQ ID NO: 15477 - protein, 9 aa, Artificial Sequence
  Description of Artificial Sequence: Synthetic peptide
  Seed: TRDPLSKIT (PIK3CA E542K)
TKDPLSKIF

SEQ ID NO: 15478 - protein, 9 aa, Artificial Sequence
  Description of Artificial Sequence: Synthetic peptide
  Seed: TRDPLSKIT (PIK3CA E542K)
TKDPLSKII

SEQ ID NO: 15479 - protein, 9 aa, Artificial Sequence
  Description of Artificial Sequence: Synthetic peptide
  Seed: TRDPLSKIT (PIK3CA E542K)
TKDPLSKIL

SEQ ID NO: 15480 - protein, 9 aa, Artificial Sequence
  Description of Artificial Sequence: Synthetic peptide
  Seed: TRDPLSKIT (PIK3CA E542K)
TKDPLSKIM

SEQ ID NO: 15481 - protein, 9 aa, Artificial Sequence
  Description of Artificial Sequence: Synthetic peptide
  Seed: TRDPLSKIT (PIK3CA E542K)
TKDPLSKIV

SEQ ID NO: 15482 - protein, 8 aa, Artificial Sequence
  Description of Artificial Sequence: Synthetic peptide
  Seed: TRDPLSKI (PIK3CA E542K)
TKDPLSKL

SEQ ID NO: 15483 - protein, 8 aa, Artificial Sequence
  Description of Artificial Sequence: Synthetic peptide
  Seed: TRDPLSKI (PIK3CA E542K)
TKDPLSKM

SEQ ID NO: 15484 - protein, 8 aa, Artificial Sequence
  Description of Artificial Sequence: Synthetic peptide
  Seed: TRDPLSKI (PIK3CA E542K)
TLDPLSKF

SEQ ID NO: 15485 - protein, 8 aa, Artificial Sequence
  Description of Artificial Sequence: Synthetic peptide
  Seed: TRDPLSKI (PIK3CA E542K)
TLDPLSKI

SEQ ID NO: 15486 - protein, 9 aa, Artificial Sequence
  Description of Artificial Sequence: Synthetic peptide
  Seed: TRDPLSKIT (PIK3CA E542K)
TLDPLSKIF

SEQ ID NO: 15487 - protein, 9 aa, Artificial Sequence
  Description of Artificial Sequence: Synthetic peptide
  Seed: TRDPLSKIT (PIK3CA E542K)
TLDPLSKII

SEQ ID NO: 15488 - protein, 9 aa, Artificial Sequence
  Description of Artificial Sequence: Synthetic peptide
  Seed: TRDPLSKIT (PIK3CA E542K)
TLDPLSKIL

SEQ ID NO: 15489 - protein, 9 aa, Artificial Sequence
  Description of Artificial Sequence: Synthetic peptide
  Seed: TRDPLSKIT (PIK3CA E542K)
TLDPLSKIM

SEQ ID NO: 15490 - protein, 9 aa, Artificial Sequence
  Description of Artificial Sequence: Synthetic peptide
  Seed: TRDPLSKIT (PIK3CA E542K)
TLDPLSKIV

SEQ ID NO: 15491 - protein, 8 aa, Artificial Sequence
  Description of Artificial Sequence: Synthetic peptide
  Seed: TRDPLSKI (PIK3CA E542K)
TLDPLSKL

SEQ ID NO: 15492 - protein, 8 aa, Artificial Sequence
  Description of Artificial Sequence: Synthetic peptide
  Seed: TRDPLSKI (PIK3CA E542K)
TLDPLSKM

SEQ ID NO: 15493 - protein, 8 aa, Artificial Sequence
  Description of Artificial Sequence: Synthetic peptide
  Seed: TRDPLSKI (PIK3CA E542K)
TLDPLSKV

SEQ ID NO: 15494 - protein, 8 aa, Artificial Sequence
  Description of Artificial Sequence: Synthetic peptide
  Seed: TRDPLSKI (PIK3CA E542K)
TMDPLSKF

SEQ ID NO: 15495 - protein, 8 aa, Artificial Sequence
  Description of Artificial Sequence: Synthetic peptide
  Seed: TRDPLSKI (PIK3CA E542K)
TMDPLSKI

SEQ ID NO: 15496 - protein, 9 aa, Artificial Sequence
  Description of Artificial Sequence: Synthetic peptide
  Seed: TRDPLSKIT (PIK3CA E542K)
TMDPLSKIC

SEQ ID NO: 15497 - protein, 9 aa, Artificial Sequence
  Description of Artificial Sequence: Synthetic peptide
  Seed: TRDPLSKIT (PIK3CA E542K)
TMDPLSKIF

SEQ ID NO: 15498 - protein, 9 aa, Artificial Sequence
  Description of Artificial Sequence: Synthetic peptide
  Seed: TRDPLSKIT (PIK3CA E542K)
TMDPLSKII

SEQ ID NO: 15499 - protein, 9 aa, Artificial Sequence
  Description of Artificial Sequence: Synthetic peptide
  Seed: TRDPLSKIT (PIK3CA E542K)
TMDPLSKIL

SEQ ID NO: 15500 - protein, 9 aa, Artificial Sequence
  Description of Artificial Sequence: Synthetic peptide
  Seed: TRDPLSKIT (PIK3CA E542K)
TMDPLSKIM

SEQ ID NO: 15501 - protein, 9 aa, Artificial Sequence
  Description of Artificial Sequence: Synthetic peptide
  Seed: TRDPLSKIT (PIK3CA E542K)
TMDPLSKIV

SEQ ID NO: 15502 - protein, 8 aa, Artificial Sequence
  Description of Artificial Sequence: Synthetic peptide
  Seed: TRDPLSKI (PIK3CA E542K)
TMDPLSKL

SEQ ID NO: 15503 - protein, 8 aa, Artificial Sequence
  Description of Artificial Sequence: Synthetic peptide
  Seed: TRDPLSKI (PIK3CA E542K)
TMDPLSKM

SEQ ID NO: 15504 - protein, 8 aa, Artificial Sequence
  Description of Artificial Sequence: Synthetic peptide
  Seed: TRDPLSKI (PIK3CA E542K)
TMDPLSKV

SEQ ID NO: 15505 - protein, 8 aa, Artificial Sequence
  Description of Artificial Sequence: Synthetic peptide
  Seed: TRDPLSKI (PIK3CA E542K)
TNDPLSKF

SEQ ID NO: 15506 - protein, 8 aa, Artificial Sequence
  Description of Artificial Sequence: Synthetic peptide
  Seed: TRDPLSKI (PIK3CA E542K)
TNDPLSKI

SEQ ID NO: 15507 - protein, 9 aa, Artificial Sequence
  Description of Artificial Sequence: Synthetic peptide
  Seed: TRDPLSKIT (PIK3CA E542K)
TNDPLSKIF

SEQ ID NO: 15508 - protein, 9 aa, Artificial Sequence
  Description of Artificial Sequence: Synthetic peptide
  Seed: TRDPLSKIT (PIK3CA E542K)
TNDPLSKII

SEQ ID NO: 15509 - protein, 9 aa, Artificial Sequence
  Description of Artificial Sequence: Synthetic peptide
  Seed: TRDPLSKIT (PIK3CA E542K)
TNDPLSKIL

SEQ ID NO: 15510 - protein, 9 aa, Artificial Sequence
  Description of Artificial Sequence: Synthetic peptide
  Seed: TRDPLSKIT (PIK3CA E542K)
TNDPLSKIM

SEQ ID NO: 15511 - protein, 9 aa, Artificial Sequence
  Description of Artificial Sequence: Synthetic peptide
  Seed: TRDPLSKIT (PIK3CA E542K)
TNDPLSKIV

SEQ ID NO: 15512 - protein, 8 aa, Artificial Sequence
  Description of Artificial Sequence: Synthetic peptide
  Seed: TRDPLSKI (PIK3CA E542K)
TNDPLSKL

SEQ ID NO: 15513 - protein, 8 aa, Artificial Sequence
  Description of Artificial Sequence: Synthetic peptide
  Seed: TRDPLSKI (PIK3CA E542K)
TNDPLSKM

SEQ ID NO: 15514 - protein, 8 aa, Artificial Sequence
  Description of Artificial Sequence: Synthetic peptide
  Seed: TRDPLSKI (PIK3CA E542K)
TNDPLSKV

SEQ ID NO: 15515 - protein, 8 aa, Artificial Sequence
  Description of Artificial Sequence: Synthetic peptide
  Seed: TRDPLSKI (PIK3CA E542K)
TPDPLSKF

SEQ ID NO: 15516 - protein, 8 aa, Artificial Sequence
  Description of Artificial Sequence: Synthetic peptide
  Seed: TRDPLSKI (PIK3CA E542K)
TPDPLSKI

SEQ ID NO: 15517 - protein, 9 aa, Artificial Sequence
  Description of Artificial Sequence: Synthetic peptide
  Seed: TRDPLSKIT (PIK3CA E542K)
TPDPLSKIF

SEQ ID NO: 15518 - protein, 9 aa, Artificial Sequence
  Description of Artificial Sequence: Synthetic peptide
  Seed: TRDPLSKIT (PIK3CA E542K)
TPDPLSKII

SEQ ID NO: 15519 - protein, 9 aa, Artificial Sequence
  Description of Artificial Sequence: Synthetic peptide
  Seed: TRDPLSKIT (PIK3CA E542K)
TPDPLSKIL

SEQ ID NO: 15520 - protein, 9 aa, Artificial Sequence
  Description of Artificial Sequence: Synthetic peptide
  Seed: TRDPLSKIT (PIK3CA E542K)
TPDPLSKIM

SEQ ID NO: 15521 - protein, 9 aa, Artificial Sequence
  Description of Artificial Sequence: Synthetic peptide
  Seed: TRDPLSKIT (PIK3CA E542K)
TPDPLSKIV

SEQ ID NO: 15522 - protein, 8 aa, Artificial Sequence
  Description of Artificial Sequence: Synthetic peptide
  Seed: TRDPLSKI (PIK3CA E542K)
TPDPLSKL

SEQ ID NO: 15523 - protein, 8 aa, Artificial Sequence
  Description of Artificial Sequence: Synthetic peptide
  Seed: TRDPLSKI (PIK3CA E542K)
TPDPLSKM

SEQ ID NO: 15524 - protein, 8 aa, Artificial Sequence
  Description of Artificial Sequence: Synthetic peptide
  Seed: TRDPLSKI (PIK3CA E542K)
TQDPLSKF

SEQ ID NO: 15525 - protein, 8 aa, Artificial Sequence
  Description of Artificial Sequence: Synthetic peptide
  Seed: TRDPLSKI (PIK3CA E542K)
TQDPLSKI

SEQ ID NO: 15526 - protein, 9 aa, Artificial Sequence
  Description of Artificial Sequence: Synthetic peptide
  Seed: TRDPLSKIT (PIK3CA E542K)
TQDPLSKIA

SEQ ID NO: 15527 - protein, 9 aa, Artificial Sequence
  Description of Artificial Sequence: Synthetic peptide
  Seed: TRDPLSKIT (PIK3CA E542K)
TQDPLSKIC

SEQ ID NO: 15528 - protein, 9 aa, Artificial Sequence
  Description of Artificial Sequence: Synthetic peptide
  Seed: TRDPLSKIT (PIK3CA E542K)
TQDPLSKIF

SEQ ID NO: 15529 - protein, 9 aa, Artificial Sequence
  Description of Artificial Sequence: Synthetic peptide
  Seed: TRDPLSKIT (PIK3CA E542K)
TQDPLSKII

SEQ ID NO: 15530 - protein, 9 aa, Artificial Sequence
  Description of Artificial Sequence: Synthetic peptide
  Seed: TRDPLSKIT (PIK3CA E542K)
TQDPLSKIL

SEQ ID NO: 15531 - protein, 9 aa, Artificial Sequence
  Description of Artificial Sequence: Synthetic peptide
  Seed: TRDPLSKIT (PIK3CA E542K)
TQDPLSKIM

SEQ ID NO: 15532 - protein, 9 aa, Artificial Sequence
  Description of Artificial Sequence: Synthetic peptide
  Seed: TRDPLSKIT (PIK3CA E542K)
TQDPLSKIV

SEQ ID NO: 15533 - protein, 9 aa, Artificial Sequence
  Description of Artificial Sequence: Synthetic peptide
  Seed: TRDPLSKIT (PIK3CA E542K)
TQDPLSKIY

SEQ ID NO: 15534 - protein, 8 aa, Artificial Sequence
  Description of Artificial Sequence: Synthetic peptide
  Seed: TRDPLSKI (PIK3CA E542K)
TQDPLSKL

SEQ ID NO: 15535 - protein, 8 aa, Artificial Sequence
  Description of Artificial Sequence: Synthetic peptide
  Seed: TRDPLSKI (PIK3CA E542K)
TQDPLSKM

SEQ ID NO: 15536 - protein, 8 aa, Artificial Sequence
  Description of Artificial Sequence: Synthetic peptide
  Seed: TRDPLSKI (PIK3CA E542K)
TQDPLSKV

SEQ ID NO: 15537 - protein, 8 aa, Artificial Sequence
  Description of Artificial Sequence: Synthetic peptide
  Seed: TRDPLSKI (PIK3CA E542K)
TQDPLSKY

SEQ ID NO: 15538 - protein, 8 aa, Artificial Sequence
  Description of Artificial Sequence: Synthetic peptide
  Seed: TRDPLSKI (PIK3CA E542K)
TRDPLSKF

SEQ ID NO: 15539 - protein, 9 aa, Artificial Sequence
  Description of Artificial Sequence: Synthetic peptide
  Seed: TRDPLSKIT (PIK3CA E542K)
TRDPLSKIA

SEQ ID NO: 15540 - protein, 9 aa, Artificial Sequence
  Description of Artificial Sequence: Synthetic peptide
  Seed: TRDPLSKIT (PIK3CA E542K)
TRDPLSKIC

SEQ ID NO: 15541 - protein, 9 aa, Artificial Sequence
  Description of Artificial Sequence: Synthetic peptide
  Seed: TRDPLSKIT (PIK3CA E542K)
TRDPLSKIF

SEQ ID NO: 15542 - protein, 9 aa, Artificial Sequence
  Description of Artificial Sequence: Synthetic peptide
  Seed: TRDPLSKIT (PIK3CA E542K)
TRDPLSKIG

SEQ ID NO: 15543 - protein, 9 aa, Artificial Sequence
  Description of Artificial Sequence: Synthetic peptide
  Seed: TRDPLSKIT (PIK3CA E542K)
TRDPLSKII

SEQ ID NO: 15544 - protein, 9 aa, Artificial Sequence
  Description of Artificial Sequence: Synthetic peptide
  Seed: TRDPLSKIT (PIK3CA E542K)
TRDPLSKIL

SEQ ID NO: 15545 - protein, 9 aa, Artificial Sequence
  Description of Artificial Sequence: Synthetic peptide
  Seed: TRDPLSKIT (PIK3CA E542K)
TRDPLSKIM

SEQ ID NO: 15546 - protein, 9 aa, Artificial Sequence
  Description of Artificial Sequence: Synthetic peptide
  Seed: TRDPLSKIT (PIK3CA E542K)
TRDPLSKIP

SEQ ID NO: 15547 - protein, 9 aa, Artificial Sequence
  Description of Artificial Sequence: Synthetic peptide
  Seed: TRDPLSKIT (PIK3CA E542K)
TRDPLSKIV

SEQ ID NO: 15548 - protein, 9 aa, Artificial Sequence
  Description of Artificial Sequence: Synthetic peptide
  Seed: TRDPLSKIT (PIK3CA E542K)
TRDPLSKIW

SEQ ID NO: 15549 - protein, 9 aa, Artificial Sequence
  Description of Artificial Sequence: Synthetic peptide
  Seed: TRDPLSKIT (PIK3CA E542K)
TRDPLSKIY

SEQ ID NO: 15550 - protein, 8 aa, Artificial Sequence
  Description of Artificial Sequence: Synthetic peptide
  Seed: TRDPLSKI (PIK3CA E542K)
TRDPLSKL

SEQ ID NO: 15551 - protein, 8 aa, Artificial Sequence
  Description of Artificial Sequence: Synthetic peptide
  Seed: TRDPLSKI (PIK3CA E542K)
TRDPLSKM

SEQ ID NO: 15552 - protein, 8 aa, Artificial Sequence
  Description of Artificial Sequence: Synthetic peptide
  Seed: TRDPLSKI (PIK3CA E542K)
TRDPLSKV

SEQ ID NO: 15553 - protein, 8 aa, Artificial Sequence
  Description of Artificial Sequence: Synthetic peptide
  Seed: TRDPLSKI (PIK3CA E542K)
TRDPLSKY

SEQ ID NO: 15554 - protein, 8 aa, Artificial Sequence
  Description of Artificial Sequence: Synthetic peptide
  Seed: TRDPLSKI (PIK3CA E542K)
TSDPLSKF

SEQ ID NO: 15555 - protein, 8 aa, Artificial Sequence
  Description of Artificial Sequence: Synthetic peptide
  Seed: TRDPLSKI (PIK3CA E542K)
TSDPLSKI

SEQ ID NO: 15556 - protein, 9 aa, Artificial Sequence
  Description of Artificial Sequence: Synthetic peptide
  Seed: TRDPLSKIT (PIK3CA E542K)
TSDPLSKIF

SEQ ID NO: 15557 - protein, 9 aa, Artificial Sequence
  Description of Artificial Sequence: Synthetic peptide
  Seed: TRDPLSKIT (PIK3CA E542K)
TSDPLSKII

SEQ ID NO: 15558 - protein, 9 aa, Artificial Sequence
  Description of Artificial Sequence: Synthetic peptide
  Seed: TRDPLSKIT (PIK3CA E542K)
TSDPLSKIL

SEQ ID NO: 15559 - protein, 9 aa, Artificial Sequence
  Description of Artificial Sequence: Synthetic peptide
  Seed: TRDPLSKIT (PIK3CA E542K)
TSDPLSKIM

SEQ ID NO: 15560 - protein, 9 aa, Artificial Sequence
  Description of Artificial Sequence: Synthetic peptide
  Seed: TRDPLSKIT (PIK3CA E542K)
TSDPLSKIV

SEQ ID NO: 15561 - protein, 8 aa, Artificial Sequence
  Description of Artificial Sequence: Synthetic peptide
  Seed: TRDPLSKI (PIK3CA E542K)
TSDPLSKL

SEQ ID NO: 15562 - protein, 8 aa, Artificial Sequence
  Description of Artificial Sequence: Synthetic peptide
  Seed: TRDPLSKI (PIK3CA E542K)
TSDPLSKM

SEQ ID NO: 15563 - protein, 8 aa, Artificial Sequence
  Description of Artificial Sequence: Synthetic peptide
  Seed: TRDPLSKI (PIK3CA E542K)
TSDPLSKV

SEQ ID NO: 15564 - protein, 8 aa, Artificial Sequence
  Description of Artificial Sequence: Synthetic peptide
  Seed: TRDPLSKI (PIK3CA E542K)
TTDPLSKF

SEQ ID NO: 15565 - protein, 8 aa, Artificial Sequence
  Description of Artificial Sequence: Synthetic peptide
  Seed: TRDPLSKI (PIK3CA E542K)
TTDPLSKI

SEQ ID NO: 15566 - protein, 9 aa, Artificial Sequence
  Description of Artificial Sequence: Synthetic peptide
  Seed: TRDPLSKIT (PIK3CA E542K)
TTDPLSKIF

SEQ ID NO: 15567 - protein, 9 aa, Artificial Sequence
  Description of Artificial Sequence: Synthetic peptide
  Seed: TRDPLSKIT (PIK3CA E542K)
TTDPLSKII

SEQ ID NO: 15568 - protein, 9 aa, Artificial Sequence
  Description of Artificial Sequence: Synthetic peptide
  Seed: TRDPLSKIT (PIK3CA E542K)
TTDPLSKIL

SEQ ID NO: 15569 - protein, 9 aa, Artificial Sequence
  Description of Artificial Sequence: Synthetic peptide
  Seed: TRDPLSKIT (PIK3CA E542K)
TTDPLSKIM

SEQ ID NO: 15570 - protein, 9 aa, Artificial Sequence
  Description of Artificial Sequence: Synthetic peptide
  Seed: TRDPLSKIT (PIK3CA E542K)
TTDPLSKIV

SEQ ID NO: 15571 - protein, 8 aa, Artificial Sequence
  Description of Artificial Sequence: Synthetic peptide
  Seed: TRDPLSKI (PIK3CA E542K)
TTDPLSKL

SEQ ID NO: 15572 - protein, 8 aa, Artificial Sequence
  Description of Artificial Sequence: Synthetic peptide
  Seed: TRDPLSKI (PIK3CA E542K)
TTDPLSKM

SEQ ID NO: 15573 - protein, 8 aa, Artificial Sequence
  Description of Artificial Sequence: Synthetic peptide
  Seed: TRDPLSKI (PIK3CA E542K)
TTDPLSKV

SEQ ID NO: 15574 - protein, 8 aa, Artificial Sequence
  Description of Artificial Sequence: Synthetic peptide
  Seed: TRDPLSKI (PIK3CA E542K)
TVDPLSKF

SEQ ID NO: 15575 - protein, 8 aa, Artificial Sequence
  Description of Artificial Sequence: Synthetic peptide
  Seed: TRDPLSKI (PIK3CA E542K)
TVDPLSKI

SEQ ID NO: 15576 - protein, 9 aa, Artificial Sequence
  Description of Artificial Sequence: Synthetic peptide
  Seed: TRDPLSKIT (PIK3CA E542K)
TVDPLSKIF

SEQ ID NO: 15577 - protein, 9 aa, Artificial Sequence
  Description of Artificial Sequence: Synthetic peptide
  Seed: TRDPLSKIT (PIK3CA E542K)
TVDPLSKII

SEQ ID NO: 15578 - protein, 9 aa, Artificial Sequence
  Description of Artificial Sequence: Synthetic peptide
  Seed: TRDPLSKIT (PIK3CA E542K)
TVDPLSKIL

SEQ ID NO: 15579 - protein, 9 aa, Artificial Sequence
  Description of Artificial Sequence: Synthetic peptide
  Seed: TRDPLSKIT (PIK3CA E542K)
TVDPLSKIM

SEQ ID NO: 15580 - protein, 9 aa, Artificial Sequence
  Description of Artificial Sequence: Synthetic peptide
  Seed: TRDPLSKIT (PIK3CA E542K)
TVDPLSKIV

SEQ ID NO: 15581 - protein, 8 aa, Artificial Sequence
  Description of Artificial Sequence: Synthetic peptide
  Seed: TRDPLSKI (PIK3CA E542K)
TVDPLSKL

SEQ ID NO: 15582 - protein, 8 aa, Artificial Sequence
  Description of Artificial Sequence: Synthetic peptide
  Seed: TRDPLSKI (PIK3CA E542K)
TVDPLSKM

SEQ ID NO: 15583 - protein, 8 aa, Artificial Sequence
  Description of Artificial Sequence: Synthetic peptide
  Seed: TRDPLSKI (PIK3CA E542K)
TVDPLSKV

SEQ ID NO: 15584 - protein, 8 aa, Artificial Sequence
  Description of Artificial Sequence: Synthetic peptide
  Seed: TRDPLSKI (PIK3CA E542K)
TWDPLSKF

SEQ ID NO: 15585 - protein, 8 aa, Artificial Sequence
  Description of Artificial Sequence: Synthetic peptide
  Seed: TRDPLSKI (PIK3CA E542K)
TWDPLSKI

SEQ ID NO: 15586 - protein, 9 aa, Artificial Sequence
  Description of Artificial Sequence: Synthetic peptide
  Seed: TRDPLSKIT (PIK3CA E542K)
TWDPLSKIA

SEQ ID NO: 15587 - protein, 9 aa, Artificial Sequence
  Description of Artificial Sequence: Synthetic peptide
  Seed: TRDPLSKIT (PIK3CA E542K)
TWDPLSKIC

SEQ ID NO: 15588 - protein, 9 aa, Artificial Sequence
  Description of Artificial Sequence: Synthetic peptide
  Seed: TRDPLSKIT (PIK3CA E542K)
TWDPLSKIF

SEQ ID NO: 15589 - protein, 9 aa, Artificial Sequence
  Description of Artificial Sequence: Synthetic peptide
  Seed: TRDPLSKIT (PIK3CA E542K)
TWDPLSKII

SEQ ID NO: 15590 - protein, 9 aa, Artificial Sequence
  Description of Artificial Sequence: Synthetic peptide
  Seed: TRDPLSKIT (PIK3CA E542K)
TWDPLSKIL

SEQ ID NO: 15591 - protein, 9 aa, Artificial Sequence
  Description of Artificial Sequence: Synthetic peptide
  Seed: TRDPLSKIT (PIK3CA E542K)
TWDPLSKIM

SEQ ID NO: 15592 - protein, 9 aa, Artificial Sequence
  Description of Artificial Sequence: Synthetic peptide
  Seed: TRDPLSKIT (PIK3CA E542K)
TWDPLSKIV

SEQ ID NO: 15593 - protein, 9 aa, Artificial Sequence
  Description of Artificial Sequence: Synthetic peptide
  Seed: TRDPLSKIT (PIK3CA E542K)
TWDPLSKIY

SEQ ID NO: 15594 - protein, 8 aa, Artificial Sequence
  Description of Artificial Sequence: Synthetic peptide
  Seed: TRDPLSKI (PIK3CA E542K)
TWDPLSKL

SEQ ID NO: 15595 - protein, 8 aa, Artificial Sequence
  Description of Artificial Sequence: Synthetic peptide
  Seed: TRDPLSKI (PIK3CA E542K)
TWDPLSKM

SEQ ID NO: 15596 - protein, 8 aa, Artificial Sequence
  Description of Artificial Sequence: Synthetic peptide
  Seed: TRDPLSKI (PIK3CA E542K)
TWDPLSKV

SEQ ID NO: 15597 - protein, 8 aa, Artificial Sequence
  Description of Artificial Sequence: Synthetic peptide
  Seed: TRDPLSKI (PIK3CA E542K)
TWDPLSKY

SEQ ID NO: 15598 - protein, 8 aa, Artificial Sequence
  Description of Artificial Sequence: Synthetic peptide
  Seed: TRDPLSKI (PIK3CA E542K)
TYDPLSKC

SEQ ID NO: 15599 - protein, 8 aa, Artificial Sequence
  Description of Artificial Sequence: Synthetic peptide
  Seed: TRDPLSKI (PIK3CA E542K)
TYDPLSKF

SEQ ID NO: 15600 - protein, 8 aa, Artificial Sequence
  Description of Artificial Sequence: Synthetic peptide
  Seed: TRDPLSKI (PIK3CA E542K)
TYDPLSKI

SEQ ID NO: 15601 - protein, 9 aa, Artificial Sequence
  Description of Artificial Sequence: Synthetic peptide
  Seed: TRDPLSKIT (PIK3CA E542K)
TYDPLSKIA

SEQ ID NO: 15602 - protein, 9 aa, Artificial Sequence
  Description of Artificial Sequence: Synthetic peptide
  Seed: TRDPLSKIT (PIK3CA E542K)
TYDPLSKIC

SEQ ID NO: 15603 - protein, 9 aa, Artificial Sequence
  Description of Artificial Sequence: Synthetic peptide
  Seed: TRDPLSKIT (PIK3CA E542K)
TYDPLSKIF

SEQ ID NO: 15604 - protein, 9 aa, Artificial Sequence
  Description of Artificial Sequence: Synthetic peptide
  Seed: TRDPLSKIT (PIK3CA E542K)
TYDPLSKII

SEQ ID NO: 15605 - protein, 9 aa, Artificial Sequence
  Description of Artificial Sequence: Synthetic peptide
  Seed: TRDPLSKIT (PIK3CA E542K)
TYDPLSKIL

SEQ ID NO: 15606 - protein, 9 aa, Artificial Sequence
  Description of Artificial Sequence: Synthetic peptide
  Seed: TRDPLSKIT (PIK3CA E542K)
TYDPLSKIM

SEQ ID NO: 15607 - protein, 9 aa, Artificial Sequence
  Description of Artificial Sequence: Synthetic peptide
  Seed: TRDPLSKIT (PIK3CA E542K)
TYDPLSKIS

SEQ ID NO: 15608 - protein, 9 aa, Artificial Sequence
  Description of Artificial Sequence: Synthetic peptide
  Seed: TRDPLSKIT (PIK3CA E542K)
TYDPLSKIT

SEQ ID NO: 15609 - protein, 9 aa, Artificial Sequence
  Description of Artificial Sequence: Synthetic peptide
  Seed: TRDPLSKIT (PIK3CA E542K)
TYDPLSKIV

SEQ ID NO: 15610 - protein, 9 aa, Artificial Sequence
  Description of Artificial Sequence: Synthetic peptide
  Seed: TRDPLSKIT (PIK3CA E542K)
TYDPLSKIW

SEQ ID NO: 15611 - protein, 9 aa, Artificial Sequence
  Description of Artificial Sequence: Synthetic peptide
  Seed: TRDPLSKIT (PIK3CA E542K)
TYDPLSKIY

SEQ ID NO: 15612 - protein, 8 aa, Artificial Sequence
  Description of Artificial Sequence: Synthetic peptide
  Seed: TRDPLSKI (PIK3CA E542K)
TYDPLSKM

SEQ ID NO: 15613 - protein, 8 aa, Artificial Sequence
  Description of Artificial Sequence: Synthetic peptide
  Seed: TRDPLSKI (PIK3CA E542K)
TYDPLSKV

SEQ ID NO: 15614 - protein, 8 aa, Artificial Sequence
  Description of Artificial Sequence: Synthetic peptide
  Seed: TRDPLSKI (PIK3CA E542K)
TYDPLSKW

SEQ ID NO: 15615 - protein, 8 aa, Artificial Sequence
  Description of Artificial Sequence: Synthetic peptide
  Seed: TRDPLSKI (PIK3CA E542K)
TYDPLSKY

SEQ ID NO: 15616 - protein, 11 aa, Homo sapiens
  Native (PIK3CA E542K)
KITEQEKDFLW

SEQ ID NO: 15617 - protein, 9 aa, Homo sapiens
  Native (PIK3CA E542K)
LSKITEQEK

SEQ ID NO: 15618 - protein, 9 aa, Homo sapiens
  Native (PIK3CA E542K)
STRDPLSKI

SEQ ID NO: 15619 - protein, 10 aa, Homo sapiens
  Native (PIK3CA E542K)
STRDPLSKIT

SEQ ID NO: 15620 - protein, 10 aa, Homo sapiens
  Native (PIK3CA E542K)
ISTRDPLSKI

SEQ ID NO: 15621 - protein, 9 aa, Homo sapiens
  Native (PIK3CA E542K)
KITEQEKDF

SEQ ID NO: 15622 - protein, 10 aa, Homo sapiens
  Native (PIK3CA E542K)
KITEQEKDFL

SEQ ID NO: 15623 - protein, 11 aa, Homo sapiens
  Native (PIK3CA E542K)
LSKITEQEKDF

SEQ ID NO: 15624 - protein, 8 aa, Homo sapiens
  Native (PIK3CA E542K)
TRDPLSKI

SEQ ID NO: 15625 - protein, 9 aa, Homo sapiens
  Native (PIK3CA E542K)
TRDPLSKIT

SEQ ID NO: 15626 - protein, 11 aa, Artificial Sequence
  Description of Artificial Sequence: Synthetic peptide
  Seed: EITKQEKDFLW (PIK3CA E545K)
EATKQEKDFLW

SEQ ID NO: 15627 - protein, 11 aa, Artificial Sequence
  Description of Artificial Sequence: Synthetic peptide
  Seed: EITKQEKDFLW (PIK3CA E545K)
EFTKQEKDFLW

SEQ ID NO: 15628 - protein, 11 aa, Artificial Sequence
  Description of Artificial Sequence: Synthetic peptide
  Seed: EITKQEKDFLW (PIK3CA E545K)
EHTKQEKDFLW

SEQ ID NO: 15629 - protein, 11 aa, Artificial Sequence
  Description of Artificial Sequence: Synthetic peptide
  Seed: EITKQEKDFLW (PIK3CA E545K)
EKTKQEKDFLW

SEQ ID NO: 15630 - protein, 11 aa, Artificial Sequence
  Description of Artificial Sequence: Synthetic peptide
  Seed: EITKQEKDFLW (PIK3CA E545K)
ELTKQEKDFLW

SEQ ID NO: 15631 - protein, 11 aa, Artificial Sequence
  Description of Artificial Sequence: Synthetic peptide
  Seed: EITKQEKDFLW (PIK3CA E545K)
EMTKQEKDFLW

SEQ ID NO: 15632 - protein, 11 aa, Artificial Sequence
  Description of Artificial Sequence: Synthetic peptide
  Seed: EITKQEKDFLW (PIK3CA E545K)
ERTKQEKDFLW

SEQ ID NO: 15633 - protein, 11 aa, Artificial Sequence
  Description of Artificial Sequence: Synthetic peptide
  Seed: EITKQEKDFLW (PIK3CA E545K)
ESTKQEKDFLW

SEQ ID NO: 15634 - protein, 11 aa, Artificial Sequence
  Description of Artificial Sequence: Synthetic peptide
  Seed: EITKQEKDFLW (PIK3CA E545K)
ETTKQEKDFLW

SEQ ID NO: 15635 - protein, 11 aa, Artificial Sequence
  Description of Artificial Sequence: Synthetic peptide
  Seed: EITKQEKDFLW (PIK3CA E545K)
EVTKQEKDFLW

SEQ ID NO: 15636 - protein, 11 aa, Artificial Sequence
  Description of Artificial Sequence: Synthetic peptide
  Seed: EITKQEKDFLW (PIK3CA E545K)
EWTKQEKDFLW

SEQ ID NO: 15637 - protein, 11 aa, Artificial Sequence
  Description of Artificial Sequence: Synthetic peptide
  Seed: EITKQEKDFLW (PIK3CA E545K)
EYTKQEKDFLW

SEQ ID NO: 15638 - protein, 10 aa, Artificial Sequence
  Description of Artificial Sequence: Synthetic peptide
  Seed: ITKQEKDFLW (PIK3CA E545K)
IAKQEKDFLF

SEQ ID NO: 15639 - protein, 11 aa, Artificial Sequence
  Description of Artificial Sequence: Synthetic peptide
  Seed: ITKQEKDFLWS (PIK3CA E545K)
IAKQEKDFLWW

SEQ ID NO: 15640 - protein, 10 aa, Artificial Sequence
  Description of Artificial Sequence: Synthetic peptide
  Seed: ITKQEKDFLW (PIK3CA E545K)
ICKQEKDFLW

SEQ ID NO: 15641 - protein, 10 aa, Artificial Sequence
  Description of Artificial Sequence: Synthetic peptide
  Seed: ITKQEKDFLW (PIK3CA E545K)
IGKQEKDFLW

SEQ ID NO: 15642 - protein, 10 aa, Artificial Sequence
  Description of Artificial Sequence: Synthetic peptide
  Seed: ITKQEKDFLW (PIK3CA E545K)
IIKQEKDFLW

SEQ ID NO: 15643 - protein, 10 aa, Artificial Sequence
  Description of Artificial Sequence: Synthetic peptide
  Seed: ITKQEKDFLW (PIK3CA E545K)
ILKQEKDFLW

SEQ ID NO: 15644 - protein, 10 aa, Artificial Sequence
  Description of Artificial Sequence: Synthetic peptide
  Seed: ITKQEKDFLW (PIK3CA E545K)
IMKQEKDFLW

SEQ ID NO: 15645 - protein, 10 aa, Artificial Sequence
  Description of Artificial Sequence: Synthetic peptide
  Seed: ITKQEKDFLW (PIK3CA E545K)
IQKQEKDFLW

SEQ ID NO: 15646 - protein, 10 aa, Artificial Sequence
  Description of Artificial Sequence: Synthetic peptide
  Seed: ITKQEKDFLW (PIK3CA E545K)
ISKQEKDFLF

SEQ ID NO: 15647 - protein, 11 aa, Artificial Sequence
  Description of Artificial Sequence: Synthetic peptide
  Seed: ITKQEKDFLWS (PIK3CA E545K)
ISKQEKDFLWF

SEQ ID NO: 15648 - protein, 11 aa, Artificial Sequence
  Description of Artificial Sequence: Synthetic peptide
  Seed: ITKQEKDFLWS (PIK3CA E545K)
ISKQEKDFLWM

SEQ ID NO: 15649 - protein, 11 aa, Artificial Sequence
  Description of Artificial Sequence: Synthetic peptide
  Seed: ITKQEKDFLWS (PIK3CA E545K)
ISKQEKDFLWW

SEQ ID NO: 15650 - protein, 11 aa, Artificial Sequence
  Description of Artificial Sequence: Synthetic peptide
  Seed: ITKQEKDFLWS (PIK3CA E545K)
ISKQEKDFLWY

SEQ ID NO: 15651 - protein, 10 aa, Artificial Sequence
  Description of Artificial Sequence: Synthetic peptide
  Seed: ITKQEKDFLW (PIK3CA E545K)
ISKQEKDFLY

SEQ ID NO: 15652 - protein, 10 aa, Artificial Sequence
  Description of Artificial Sequence: Synthetic peptide
  Seed: ITKQEKDFLW (PIK3CA E545K)
ITKQEKDFLF

SEQ ID NO: 15653 - protein, 11 aa, Artificial Sequence
  Description of Artificial Sequence: Synthetic peptide
  Seed: ITKQEKDFLWS (PIK3CA E545K)
ITKQEKDFLWA

SEQ ID NO: 15654 - protein, 11 aa, Artificial Sequence
  Description of Artificial Sequence: Synthetic peptide
  Seed: ITKQEKDFLWS (PIK3CA E545K)
ITKQEKDFLWC

SEQ ID NO: 15655 - protein, 11 aa, Artificial Sequence
  Description of Artificial Sequence: Synthetic peptide
  Seed: ITKQEKDFLWS (PIK3CA E545K)
ITKQEKDFLWD

SEQ ID NO: 15656 - protein, 11 aa, Artificial Sequence
  Description of Artificial Sequence: Synthetic peptide
  Seed: ITKQEKDFLWS (PIK3CA E545K)
ITKQEKDFLWE

SEQ ID NO: 15657 - protein, 11 aa, Artificial Sequence
  Description of Artificial Sequence: Synthetic peptide
  Seed: ITKQEKDFLWS (PIK3CA E545K)
ITKQEKDFLWF

SEQ ID NO: 15658 - protein, 11 aa, Artificial Sequence
  Description of Artificial Sequence: Synthetic peptide
  Seed: ITKQEKDFLWS (PIK3CA E545K)
ITKQEKDFLWG

SEQ ID NO: 15659 - protein, 11 aa, Artificial Sequence
  Description of Artificial Sequence: Synthetic peptide
  Seed: ITKQEKDFLWS (PIK3CA E545K)
ITKQEKDFLWH

SEQ ID NO: 15660 - protein, 11 aa, Artificial Sequence
  Description of Artificial Sequence: Synthetic peptide
  Seed: ITKQEKDFLWS (PIK3CA E545K)
ITKQEKDFLWI

SEQ ID NO: 15661 - protein, 11 aa, Artificial Sequence
  Description of Artificial Sequence: Synthetic peptide
  Seed: ITKQEKDFLWS (PIK3CA E545K)
ITKQEKDFLWK

SEQ ID NO: 15662 - protein, 11 aa, Artificial Sequence
  Description of Artificial Sequence: Synthetic peptide
  Seed: ITKQEKDFLWS (PIK3CA E545K)
ITKQEKDFLWL

SEQ ID NO: 15663 - protein, 11 aa, Artificial Sequence
  Description of Artificial Sequence: Synthetic peptide
  Seed: ITKQEKDFLWS (PIK3CA E545K)
ITKQEKDFLWM

SEQ ID NO: 15664 - protein, 11 aa, Artificial Sequence
  Description of Artificial Sequence: Synthetic peptide
  Seed: ITKQEKDFLWS (PIK3CA E545K)
ITKQEKDFLWN

SEQ ID NO: 15665 - protein, 11 aa, Artificial Sequence
  Description of Artificial Sequence: Synthetic peptide
  Seed: ITKQEKDFLWS (PIK3CA E545K)
ITKQEKDFLWP

SEQ ID NO: 15666 - protein, 11 aa, Artificial Sequence
  Description of Artificial Sequence: Synthetic peptide
  Seed: ITKQEKDFLWS (PIK3CA E545K)
ITKQEKDFLWQ

SEQ ID NO: 15667 - protein, 11 aa, Artificial Sequence
  Description of Artificial Sequence: Synthetic peptide
  Seed: ITKQEKDFLWS (PIK3CA E545K)
ITKQEKDFLWR

SEQ ID NO: 15668 - protein, 11 aa, Artificial Sequence
  Description of Artificial Sequence: Synthetic peptide
  Seed: ITKQEKDFLWS (PIK3CA E545K)
ITKQEKDFLWT

SEQ ID NO: 15669 - protein, 11 aa, Artificial Sequence
  Description of Artificial Sequence: Synthetic peptide
  Seed: ITKQEKDFLWS (PIK3CA E545K)
ITKQEKDFLWV

SEQ ID NO: 15670 - protein, 11 aa, Artificial Sequence
  Description of Artificial Sequence: Synthetic peptide
  Seed: ITKQEKDFLWS (PIK3CA E545K)
ITKQEKDFLWW

SEQ ID NO: 15671 - protein, 11 aa, Artificial Sequence
  Description of Artificial Sequence: Synthetic peptide
  Seed: ITKQEKDFLWS (PIK3CA E545K)
ITKQEKDFLWY

SEQ ID NO: 15672 - protein, 10 aa, Artificial Sequence
  Description of Artificial Sequence: Synthetic peptide
  Seed: ITKQEKDFLW (PIK3CA E545K)
ITKQEKDFLY

SEQ ID NO: 15673 - protein, 10 aa, Artificial Sequence
  Description of Artificial Sequence: Synthetic peptide
  Seed: ITKQEKDFLW (PIK3CA E545K)
IVKQEKDFLW

SEQ ID NO: 15674 - protein, 11 aa, Artificial Sequence
  Description of Artificial Sequence: Synthetic peptide
  Seed: KQEKDFLWSHR (PIK3CA E545K)
KAEKDFLWSHR

SEQ ID NO: 15675 - protein, 11 aa, Artificial Sequence
  Description of Artificial Sequence: Synthetic peptide
  Seed: KQEKDFLWSHR (PIK3CA E545K)
KFEKDFLWSHK

SEQ ID NO: 15676 - protein, 11 aa, Artificial Sequence
  Description of Artificial Sequence: Synthetic peptide
  Seed: KQEKDFLWSHR (PIK3CA E545K)
KFEKDFLWSHR

SEQ ID NO: 15677 - protein, 11 aa, Artificial Sequence
  Description of Artificial Sequence: Synthetic peptide
  Seed: KQEKDFLWSHR (PIK3CA E545K)
KIEKDFLWSHR

SEQ ID NO: 15678 - protein, 11 aa, Artificial Sequence
  Description of Artificial Sequence: Synthetic peptide
  Seed: KQEKDFLWSHR (PIK3CA E545K)
KLEKDFLWSHR

SEQ ID NO: 15679 - protein, 11 aa, Artificial Sequence
  Description of Artificial Sequence: Synthetic peptide
  Seed: KQEKDFLWSHR (PIK3CA E545K)
KMEKDFLWSHK

SEQ ID NO: 15680 - protein, 11 aa, Artificial Sequence
  Description of Artificial Sequence: Synthetic peptide
  Seed: KQEKDFLWSHR (PIK3CA E545K)
KMEKDFLWSHR

SEQ ID NO: 15681 - protein, 11 aa, Artificial Sequence
  Description of Artificial Sequence: Synthetic peptide
  Seed: KQEKDFLWSHR (PIK3CA E545K)
KSEKDFLWSHR

SEQ ID NO: 15682 - protein, 11 aa, Artificial Sequence
  Description of Artificial Sequence: Synthetic peptide
  Seed: KQEKDFLWSHR (PIK3CA E545K)
KTEKDFLWSHR

SEQ ID NO: 15683 - protein, 11 aa, Artificial Sequence
  Description of Artificial Sequence: Synthetic peptide
  Seed: KQEKDFLWSHR (PIK3CA E545K)
KVEKDFLWSHR

SEQ ID NO: 15684 - protein, 11 aa, Artificial Sequence
  Description of Artificial Sequence: Synthetic peptide
  Seed: KQEKDFLWSHR (PIK3CA E545K)
KWEKDFLWSHR

SEQ ID NO: 15685 - protein, 11 aa, Artificial Sequence
  Description of Artificial Sequence: Synthetic peptide
  Seed: KQEKDFLWSHR (PIK3CA E545K)
KYEKDFLWSHK

SEQ ID NO: 15686 - protein, 11 aa, Artificial Sequence
  Description of Artificial Sequence: Synthetic peptide
  Seed: KQEKDFLWSHR (PIK3CA E545K)
KYEKDFLWSHR

SEQ ID NO: 15687 - protein, 10 aa, Artificial Sequence
  Description of Artificial Sequence: Synthetic peptide
  Seed: SEITKQEKDF (PIK3CA E545K)
SEITKQEKDY

SEQ ID NO: 15688 - protein, 11 aa, Artificial Sequence
  Description of Artificial Sequence: Synthetic peptide
  Seed: EITKQEKDFLW (PIK3CA E545K)
EATKQEKDFLF

SEQ ID NO: 15689 - protein, 11 aa, Artificial Sequence
  Description of Artificial Sequence: Synthetic peptide
  Seed: EITKQEKDFLW (PIK3CA E545K)
ECTKQEKDFLW

SEQ ID NO: 15690 - protein, 11 aa, Artificial Sequence
  Description of Artificial Sequence: Synthetic peptide
  Seed: EITKQEKDFLW (PIK3CA E545K)
EGTKQEKDFLW

SEQ ID NO: 15691 - protein, 11 aa, Artificial Sequence
  Description of Artificial Sequence: Synthetic peptide
  Seed: EITKQEKDFLW (PIK3CA E545K)
ENTKQEKDFLW

SEQ ID NO: 15692 - protein, 11 aa, Artificial Sequence
  Description of Artificial Sequence: Synthetic peptide
  Seed: EITKQEKDFLW (PIK3CA E545K)
ESTKQEKDFLF

SEQ ID NO: 15693 - protein, 11 aa, Artificial Sequence
  Description of Artificial Sequence: Synthetic peptide
  Seed: EITKQEKDFLW (PIK3CA E545K)
ETTKQEKDFLF

SEQ ID NO: 15694 - protein, 9 aa, Artificial Sequence
  Description of Artificial Sequence: Synthetic peptide
  Seed: ITKQEKDFL (PIK3CA E545K)
IAKQEKDFF

SEQ ID NO: 15695 - protein, 9 aa, Artificial Sequence
  Description of Artificial Sequence: Synthetic peptide
  Seed: ITKQEKDFL (PIK3CA E545K)
IAKQEKDFI

SEQ ID NO: 15696 - protein, 9 aa, Artificial Sequence
  Description of Artificial Sequence: Synthetic peptide
  Seed: ITKQEKDFL (PIK3CA E545K)
IAKQEKDFL

SEQ ID NO: 15697 - protein, 10 aa, Artificial Sequence
  Description of Artificial Sequence: Synthetic peptide
  Seed: ITKQEKDFLW (PIK3CA E545K)
IAKQEKDFLL

SEQ ID NO: 15698 - protein, 10 aa, Artificial Sequence
  Description of Artificial Sequence: Synthetic peptide
  Seed: ITKQEKDFLW (PIK3CA E545K)
IAKQEKDFLY

SEQ ID NO: 15699 - protein, 9 aa, Artificial Sequence
  Description of Artificial Sequence: Synthetic peptide
  Seed: ITKQEKDFL (PIK3CA E545K)
IAKQEKDFM

SEQ ID NO: 15700 - protein, 9 aa, Artificial Sequence
  Description of Artificial Sequence: Synthetic peptide
  Seed: ITKQEKDFL (PIK3CA E545K)
IAKQEKDFV

SEQ ID NO: 15701 - protein, 9 aa, Artificial Sequence
  Description of Artificial Sequence: Synthetic peptide
  Seed: ITKQEKDFL (PIK3CA E545K)
IAKQEKDFW

SEQ ID NO: 15702 - protein, 9 aa, Artificial Sequence
  Description of Artificial Sequence: Synthetic peptide
  Seed: ITKQEKDFL (PIK3CA E545K)
IAKQEKDFY

SEQ ID NO: 15703 - protein, 9 aa, Artificial Sequence
  Description of Artificial Sequence: Synthetic peptide
  Seed: ITKQEKDFL (PIK3CA E545K)
ICKQEKDFF

SEQ ID NO: 15704 - protein, 10 aa, Artificial Sequence
  Description of Artificial Sequence: Synthetic peptide
  Seed: ITKQEKDFLW (PIK3CA E545K)
ICKQEKDFLF

SEQ ID NO: 15705 - protein, 9 aa, Artificial Sequence
  Description of Artificial Sequence: Synthetic peptide
  Seed: ITKQEKDFL (PIK3CA E545K)
ICKQEKDFW

SEQ ID NO: 15706 - protein, 10 aa, Artificial Sequence
  Description of Artificial Sequence: Synthetic peptide
  Seed: ITKQEKDFLW (PIK3CA E545K)
IDKQEKDFLW

SEQ ID NO: 15707 - protein, 10 aa, Artificial Sequence
  Description of Artificial Sequence: Synthetic peptide
  Seed: ITKQEKDFLW (PIK3CA E545K)
IEKQEKDFLW

SEQ ID NO: 15708 - protein, 10 aa, Artificial Sequence
  Description of Artificial Sequence: Synthetic peptide
  Seed: ITKQEKDFLW (PIK3CA E545K)
IFKQEKDFLW

SEQ ID NO: 15709 - protein, 9 aa, Artificial Sequence
  Description of Artificial Sequence: Synthetic peptide
  Seed: ITKQEKDFL (PIK3CA E545K)
IFKQEKDFW

SEQ ID NO: 15710 - protein, 9 aa, Artificial Sequence
  Description of Artificial Sequence: Synthetic peptide
  Seed: ITKQEKDFL (PIK3CA E545K)
IGKQEKDFF

SEQ ID NO: 15711 - protein, 10 aa, Artificial Sequence
  Description of Artificial Sequence: Synthetic peptide
  Seed: ITKQEKDFLW (PIK3CA E545K)
IGKQEKDFLF

SEQ ID NO: 15712 - protein, 9 aa, Artificial Sequence
  Description of Artificial Sequence: Synthetic peptide
  Seed: ITKQEKDFL (PIK3CA E545K)
IGKQEKDFW

SEQ ID NO: 15713 - protein, 9 aa, Artificial Sequence
  Description of Artificial Sequence: Synthetic peptide
  Seed: ITKQEKDFL (PIK3CA E545K)
IIKQEKDFF

SEQ ID NO: 15714 - protein, 10 aa, Artificial Sequence
  Description of Artificial Sequence: Synthetic peptide
  Seed: ITKQEKDFLW (PIK3CA E545K)
IIKQEKDFLF

SEQ ID NO: 15715 - protein, 9 aa, Artificial Sequence
  Description of Artificial Sequence: Synthetic peptide
  Seed: ITKQEKDFL (PIK3CA E545K)
IIKQEKDFW

SEQ ID NO: 15716 - protein, 9 aa, Artificial Sequence
  Description of Artificial Sequence: Synthetic peptide
  Seed: ITKQEKDFL (PIK3CA E545K)
IIKQEKDFY

SEQ ID NO: 15717 - protein, 9 aa, Artificial Sequence
  Description of Artificial Sequence: Synthetic peptide
  Seed: ITKQEKDFL (PIK3CA E545K)
ILKQEKDFW

SEQ ID NO: 15718 - protein, 9 aa, Artificial Sequence
  Description of Artificial Sequence: Synthetic peptide
  Seed: ITKQEKDFL (PIK3CA E545K)
IMKQEKDFF

SEQ ID NO: 15719 - protein, 10 aa, Artificial Sequence
  Description of Artificial Sequence: Synthetic peptide
  Seed: ITKQEKDFLW (PIK3CA E545K)
IMKQEKDFLF

SEQ ID NO: 15720 - protein, 9 aa, Artificial Sequence
  Description of Artificial Sequence: Synthetic peptide
  Seed: ITKQEKDFL (PIK3CA E545K)
IMKQEKDFW

SEQ ID NO: 15721 - protein, 10 aa, Artificial Sequence
  Description of Artificial Sequence: Synthetic peptide
  Seed: ITKQEKDFLW (PIK3CA E545K)
INKQEKDFLW

SEQ ID NO: 15722 - protein, 9 aa, Artificial Sequence
  Description of Artificial Sequence: Synthetic peptide
  Seed: ITKQEKDFL (PIK3CA E545K)
INKQEKDFW

SEQ ID NO: 15723 - protein, 10 aa, Artificial Sequence
  Description of Artificial Sequence: Synthetic peptide
  Seed: ITKQEKDFLW (PIK3CA E545K)
IPKQEKDFLW

SEQ ID NO: 15724 - protein, 9 aa, Artificial Sequence
  Description of Artificial Sequence: Synthetic peptide
  Seed: ITKQEKDFL (PIK3CA E545K)
IPKQEKDFW

SEQ ID NO: 15725 - protein, 9 aa, Artificial Sequence
  Description of Artificial Sequence: Synthetic peptide
  Seed: ITKQEKDFL (PIK3CA E545K)
IQKQEKDFW

SEQ ID NO: 15726 - protein, 9 aa, Artificial Sequence
  Description of Artificial Sequence: Synthetic peptide
  Seed: ITKQEKDFL (PIK3CA E545K)
ISKQEKDFF

SEQ ID NO: 15727 - protein, 9 aa, Artificial Sequence
  Description of Artificial Sequence: Synthetic peptide
  Seed: ITKQEKDFL (PIK3CA E545K)
ISKQEKDFI

SEQ ID NO: 15728 - protein, 9 aa, Artificial Sequence
  Description of Artificial Sequence: Synthetic peptide
  Seed: ITKQEKDFL (PIK3CA E545K)
ISKQEKDFL

SEQ ID NO: 15729 - protein, 10 aa, Artificial Sequence
  Description of Artificial Sequence: Synthetic peptide
  Seed: ITKQEKDFLW (PIK3CA E545K)
ISKQEKDFLI

SEQ ID NO: 15730 - protein, 10 aa, Artificial Sequence
  Description of Artificial Sequence: Synthetic peptide
  Seed: ITKQEKDFLW (PIK3CA E545K)
ISKQEKDFLL

SEQ ID NO: 15731 - protein, 10 aa, Artificial Sequence
  Description of Artificial Sequence: Synthetic peptide
  Seed: ITKQEKDFLW (PIK3CA E545K)
ISKQEKDFLM

SEQ ID NO: 15732 - protein, 9 aa, Artificial Sequence
  Description of Artificial Sequence: Synthetic peptide
  Seed: ITKQEKDFL (PIK3CA E545K)
ISKQEKDFM

SEQ ID NO: 15733 - protein, 9 aa, Artificial Sequence
  Description of Artificial Sequence: Synthetic peptide
  Seed: ITKQEKDFL (PIK3CA E545K)
ISKQEKDFV

SEQ ID NO: 15734 - protein, 9 aa, Artificial Sequence
  Description of Artificial Sequence: Synthetic peptide
  Seed: ITKQEKDFL (PIK3CA E545K)
ISKQEKDFW

SEQ ID NO: 15735 - protein, 9 aa, Artificial Sequence
  Description of Artificial Sequence: Synthetic peptide
  Seed: ITKQEKDFL (PIK3CA E545K)
ISKQEKDFY

SEQ ID NO: 15736 - protein, 9 aa, Artificial Sequence
  Description of Artificial Sequence: Synthetic peptide
  Seed: ITKQEKDFL (PIK3CA E545K)
ITKQEKDFF

SEQ ID NO: 15737 - protein, 9 aa, Artificial Sequence
  Description of Artificial Sequence: Synthetic peptide
  Seed: ITKQEKDFL (PIK3CA E545K)
ITKQEKDFI

SEQ ID NO: 15738 - protein, 10 aa, Artificial Sequence
  Description of Artificial Sequence: Synthetic peptide
  Seed: ITKQEKDFLW (PIK3CA E545K)
ITKQEKDFLI

SEQ ID NO: 15739 - protein, 10 aa, Artificial Sequence
  Description of Artificial Sequence: Synthetic peptide
  Seed: ITKQEKDFLW (PIK3CA E545K)
ITKQEKDFLL

SEQ ID NO: 15740 - protein, 10 aa, Artificial Sequence
  Description of Artificial Sequence: Synthetic peptide
  Seed: ITKQEKDFLW (PIK3CA E545K)
ITKQEKDFLM

SEQ ID NO: 15741 - protein, 9 aa, Artificial Sequence
  Description of Artificial Sequence: Synthetic peptide
  Seed: ITKQEKDFL (PIK3CA E545K)
ITKQEKDFM

SEQ ID NO: 15742 - protein, 9 aa, Artificial Sequence
  Description of Artificial Sequence: Synthetic peptide
  Seed: ITKQEKDFL (PIK3CA E545K)
ITKQEKDFV

SEQ ID NO: 15743 - protein, 9 aa, Artificial Sequence
  Description of Artificial Sequence: Synthetic peptide
  Seed: ITKQEKDFL (PIK3CA E545K)
ITKQEKDFW

SEQ ID NO: 15744 - protein, 9 aa, Artificial Sequence
  Description of Artificial Sequence: Synthetic peptide
  Seed: ITKQEKDFL (PIK3CA E545K)
ITKQEKDFY

SEQ ID NO: 15745 - protein, 9 aa, Artificial Sequence
  Description of Artificial Sequence: Synthetic peptide
  Seed: ITKQEKDFL (PIK3CA E545K)
IVKQEKDFF

SEQ ID NO: 15746 - protein, 10 aa, Artificial Sequence
  Description of Artificial Sequence: Synthetic peptide
  Seed: ITKQEKDFLW (PIK3CA E545K)
IVKQEKDFLF

SEQ ID NO: 15747 - protein, 9 aa, Artificial Sequence
  Description of Artificial Sequence: Synthetic peptide
  Seed: ITKQEKDFL (PIK3CA E545K)
IVKQEKDFM

SEQ ID NO: 15748 - protein, 9 aa, Artificial Sequence
  Description of Artificial Sequence: Synthetic peptide
  Seed: ITKQEKDFL (PIK3CA E545K)
IVKQEKDFW

SEQ ID NO: 15749 - protein, 9 aa, Artificial Sequence
  Description of Artificial Sequence: Synthetic peptide
  Seed: ITKQEKDFL (PIK3CA E545K)
IVKQEKDFY

SEQ ID NO: 15750 - protein, 10 aa, Artificial Sequence
  Description of Artificial Sequence: Synthetic peptide
  Seed: ITKQEKDFLW (PIK3CA E545K)
IWKQEKDFLW

SEQ ID NO: 15751 - protein, 9 aa, Artificial Sequence
  Description of Artificial Sequence: Synthetic peptide
  Seed: LSEITKQEK (PIK3CA E545K)
LAEITKQEF

SEQ ID NO: 15752 - protein, 9 aa, Artificial Sequence
  Description of Artificial Sequence: Synthetic peptide
  Seed: LSEITKQEK (PIK3CA E545K)
LAEITKQEI

SEQ ID NO: 15753 - protein, 9 aa, Artificial Sequence
  Description of Artificial Sequence: Synthetic peptide
  Seed: LSEITKQEK (PIK3CA E545K)
LAEITKQEK

SEQ ID NO: 15754 - protein, 9 aa, Artificial Sequence
  Description of Artificial Sequence: Synthetic peptide
  Seed: LSEITKQEK (PIK3CA E545K)
LAEITKQEL

SEQ ID NO: 15755 - protein, 9 aa, Artificial Sequence
  Description of Artificial Sequence: Synthetic peptide
  Seed: LSEITKQEK (PIK3CA E545K)
LAEITKQEM

SEQ ID NO: 15756 - protein, 9 aa, Artificial Sequence
  Description of Artificial Sequence: Synthetic peptide
  Seed: LSEITKQEK (PIK3CA E545K)
LAEITKQER

SEQ ID NO: 15757 - protein, 9 aa, Artificial Sequence
  Description of Artificial Sequence: Synthetic peptide
  Seed: LSEITKQEK (PIK3CA E545K)
LAEITKQEV

SEQ ID NO: 15758 - protein, 9 aa, Artificial Sequence
  Description of Artificial Sequence: Synthetic peptide
  Seed: LSEITKQEK (PIK3CA E545K)
LAEITKQEW

SEQ ID NO: 15759 - protein, 9 aa, Artificial Sequence
  Description of Artificial Sequence: Synthetic peptide
  Seed: LSEITKQEK (PIK3CA E545K)
LAEITKQEY

SEQ ID NO: 15760 - protein, 9 aa, Artificial Sequence
  Description of Artificial Sequence: Synthetic peptide
  Seed: LSEITKQEK (PIK3CA E545K)
LCEITKQEY

SEQ ID NO: 15761 - protein, 9 aa, Artificial Sequence
  Description of Artificial Sequence: Synthetic peptide
  Seed: LSEITKQEK (PIK3CA E545K)
LDEITKQEK

SEQ ID NO: 15762 - protein, 9 aa, Artificial Sequence
  Description of Artificial Sequence: Synthetic peptide
  Seed: LSEITKQEK (PIK3CA E545K)
LDEITKQEY

SEQ ID NO: 15763 - protein, 9 aa, Artificial Sequence
  Description of Artificial Sequence: Synthetic peptide
  Seed: LSEITKQEK (PIK3CA E545K)
LEEITKQEK

SEQ ID NO: 15764 - protein, 9 aa, Artificial Sequence
  Description of Artificial Sequence: Synthetic peptide
  Seed: LSEITKQEK (PIK3CA E545K)
LEEITKQEY

SEQ ID NO: 15765 - protein, 9 aa, Artificial Sequence
  Description of Artificial Sequence: Synthetic peptide
  Seed: LSEITKQEK (PIK3CA E545K)
LFEITKQEF

SEQ ID NO: 15766 - protein, 9 aa, Artificial Sequence
  Description of Artificial Sequence: Synthetic peptide
  Seed: LSEITKQEK (PIK3CA E545K)
LFEITKQEL

SEQ ID NO: 15767 - protein, 9 aa, Artificial Sequence
  Description of Artificial Sequence: Synthetic peptide
  Seed: LSEITKQEK (PIK3CA E545K)
LFEITKQEM

SEQ ID NO: 15768 - protein, 9 aa, Artificial Sequence
  Description of Artificial Sequence: Synthetic peptide
  Seed: LSEITKQEK (PIK3CA E545K)
LFEITKQEY

SEQ ID NO: 15769 - protein, 9 aa, Artificial Sequence
  Description of Artificial Sequence: Synthetic peptide
  Seed: LSEITKQEK (PIK3CA E545K)
LGEITKQEF

SEQ ID NO: 15770 - protein, 9 aa, Artificial Sequence
  Description of Artificial Sequence: Synthetic peptide
  Seed: LSEITKQEK (PIK3CA E545K)
LGEITKQEK

SEQ ID NO: 15771 - protein, 9 aa, Artificial Sequence
  Description of Artificial Sequence: Synthetic peptide
  Seed: LSEITKQEK (PIK3CA E545K)
LGEITKQEL

SEQ ID NO: 15772 - protein, 9 aa, Artificial Sequence
  Description of Artificial Sequence: Synthetic peptide
  Seed: LSEITKQEK (PIK3CA E545K)
LGEITKQEM

SEQ ID NO: 15773 - protein, 9 aa, Artificial Sequence
  Description of Artificial Sequence: Synthetic peptide
  Seed: LSEITKQEK (PIK3CA E545K)
LGEITKQER

SEQ ID NO: 15774 - protein, 9 aa, Artificial Sequence
  Description of Artificial Sequence: Synthetic peptide
  Seed: LSEITKQEK (PIK3CA E545K)
LGEITKQEY

SEQ ID NO: 15775 - protein, 9 aa, Artificial Sequence
  Description of Artificial Sequence: Synthetic peptide
  Seed: LSEITKQEK (PIK3CA E545K)
LIEITKQEF

SEQ ID NO: 15776 - protein, 9 aa, Artificial Sequence
  Description of Artificial Sequence: Synthetic peptide
  Seed: LSEITKQEK (PIK3CA E545K)
LIEITKQEK

SEQ ID NO: 15777 - protein, 9 aa, Artificial Sequence
  Description of Artificial Sequence: Synthetic peptide
  Seed: LSEITKQEK (PIK3CA E545K)
LIEITKQEL

SEQ ID NO: 15778 - protein, 9 aa, Artificial Sequence
  Description of Artificial Sequence: Synthetic peptide
  Seed: LSEITKQEK (PIK3CA E545K)
LIEITKQEM

SEQ ID NO: 15779 - protein, 9 aa, Artificial Sequence
  Description of Artificial Sequence: Synthetic peptide
  Seed: LSEITKQEK (PIK3CA E545K)
LIEITKQER

SEQ ID NO: 15780 - protein, 9 aa, Artificial Sequence
  Description of Artificial Sequence: Synthetic peptide
  Seed: LSEITKQEK (PIK3CA E545K)
LIEITKQEY

SEQ ID NO: 15781 - protein, 9 aa, Artificial Sequence
  Description of Artificial Sequence: Synthetic peptide
  Seed: LSEITKQEK (PIK3CA E545K)
LLEITKQEF

SEQ ID NO: 15782 - protein, 9 aa, Artificial Sequence
  Description of Artificial Sequence: Synthetic peptide
  Seed: LSEITKQEK (PIK3CA E545K)
LLEITKQEK

SEQ ID NO: 15783 - protein, 9 aa, Artificial Sequence
  Description of Artificial Sequence: Synthetic peptide
  Seed: LSEITKQEK (PIK3CA E545K)
LLEITKQEL

SEQ ID NO: 15784 - protein, 9 aa, Artificial Sequence
  Description of Artificial Sequence: Synthetic peptide
  Seed: LSEITKQEK (PIK3CA E545K)
LLEITKQEM

SEQ ID NO: 15785 - protein, 9 aa, Artificial Sequence
  Description of Artificial Sequence: Synthetic peptide
  Seed: LSEITKQEK (PIK3CA E545K)
LLEITKQEY

SEQ ID NO: 15786 - protein, 9 aa, Artificial Sequence
  Description of Artificial Sequence: Synthetic peptide
  Seed: LSEITKQEK (PIK3CA E545K)
LMEITKQEF

SEQ ID NO: 15787 - protein, 9 aa, Artificial Sequence
  Description of Artificial Sequence: Synthetic peptide
  Seed: LSEITKQEK (PIK3CA E545K)
LMEITKQEK

SEQ ID NO: 15788 - protein, 9 aa, Artificial Sequence
  Description of Artificial Sequence: Synthetic peptide
  Seed: LSEITKQEK (PIK3CA E545K)
LMEITKQEL

SEQ ID NO: 15789 - protein, 9 aa, Artificial Sequence
  Description of Artificial Sequence: Synthetic peptide
  Seed: LSEITKQEK (PIK3CA E545K)
LMEITKQEM

SEQ ID NO: 15790 - protein, 9 aa, Artificial Sequence
  Description of Artificial Sequence: Synthetic peptide
  Seed: LSEITKQEK (PIK3CA E545K)
LMEITKQEY

SEQ ID NO: 15791 - protein, 9 aa, Artificial Sequence
  Description of Artificial Sequence: Synthetic peptide
  Seed: LSEITKQEK (PIK3CA E545K)
LNEITKQEK

SEQ ID NO: 15792 - protein, 9 aa, Artificial Sequence
  Description of Artificial Sequence: Synthetic peptide
  Seed: LSEITKQEK (PIK3CA E545K)
LNEITKQEY

SEQ ID NO: 15793 - protein, 9 aa, Artificial Sequence
  Description of Artificial Sequence: Synthetic peptide
  Seed: LSEITKQEK (PIK3CA E545K)
LQEITKQEK

SEQ ID NO: 15794 - protein, 9 aa, Artificial Sequence
  Description of Artificial Sequence: Synthetic peptide
  Seed: LSEITKQEK (PIK3CA E545K)
LQEITKQEY

SEQ ID NO: 15795 - protein, 9 aa, Artificial Sequence
  Description of Artificial Sequence: Synthetic peptide
  Seed: LSEITKQEK (PIK3CA E545K)
LSEITKQEF

SEQ ID NO: 15796 - protein, 9 aa, Artificial Sequence
  Description of Artificial Sequence: Synthetic peptide
  Seed: LSEITKQEK (PIK3CA E545K)
LSEITKQEH

SEQ ID NO: 15797 - protein, 9 aa, Artificial Sequence
  Description of Artificial Sequence: Synthetic peptide
  Seed: LSEITKQEK (PIK3CA E545K)
LSEITKQEI

SEQ ID NO: 15798 - protein, 9 aa, Artificial Sequence
  Description of Artificial Sequence: Synthetic peptide
  Seed: LSEITKQEK (PIK3CA E545K)
LSEITKQEL

SEQ ID NO: 15799 - protein, 9 aa, Artificial Sequence
  Description of Artificial Sequence: Synthetic peptide
  Seed: LSEITKQEK (PIK3CA E545K)
LSEITKQEM

SEQ ID NO: 15800 - protein, 9 aa, Artificial Sequence
  Description of Artificial Sequence: Synthetic peptide
  Seed: LSEITKQEK (PIK3CA E545K)
LSEITKQER

SEQ ID NO: 15801 - protein, 9 aa, Artificial Sequence
  Description of Artificial Sequence: Synthetic peptide
  Seed: LSEITKQEK (PIK3CA E545K)
LSEITKQEV

SEQ ID NO: 15802 - protein, 9 aa, Artificial Sequence
  Description of Artificial Sequence: Synthetic peptide
  Seed: LSEITKQEK (PIK3CA E545K)
LSEITKQEW

SEQ ID NO: 15803 - protein, 9 aa, Artificial Sequence
  Description of Artificial Sequence: Synthetic peptide
  Seed: LSEITKQEK (PIK3CA E545K)
LTEITKQEF

SEQ ID NO: 15804 - protein, 9 aa, Artificial Sequence
  Description of Artificial Sequence: Synthetic peptide
  Seed: LSEITKQEK (PIK3CA E545K)
LTEITKQEH

SEQ ID NO: 15805 - protein, 9 aa, Artificial Sequence
  Description of Artificial Sequence: Synthetic peptide
  Seed: LSEITKQEK (PIK3CA E545K)
LTEITKQEI

SEQ ID NO: 15806 - protein, 9 aa, Artificial Sequence
  Description of Artificial Sequence: Synthetic peptide
  Seed: LSEITKQEK (PIK3CA E545K)
LTEITKQEK

SEQ ID NO: 15807 - protein, 9 aa, Artificial Sequence
  Description of Artificial Sequence: Synthetic peptide
  Seed: LSEITKQEK (PIK3CA E545K)
LTEITKQEL

SEQ ID NO: 15808 - protein, 9 aa, Artificial Sequence
  Description of Artificial Sequence: Synthetic peptide
  Seed: LSEITKQEK (PIK3CA E545K)
LTEITKQEM

SEQ ID NO: 15809 - protein, 9 aa, Artificial Sequence
  Description of Artificial Sequence: Synthetic peptide
  Seed: LSEITKQEK (PIK3CA E545K)
LTEITKQER

SEQ ID NO: 15810 - protein, 9 aa, Artificial Sequence
  Description of Artificial Sequence: Synthetic peptide
  Seed: LSEITKQEK (PIK3CA E545K)
LTEITKQEV

SEQ ID NO: 15811 - protein, 9 aa, Artificial Sequence
  Description of Artificial Sequence: Synthetic peptide
  Seed: LSEITKQEK (PIK3CA E545K)
LTEITKQEW

SEQ ID NO: 15812 - protein, 9 aa, Artificial Sequence
  Description of Artificial Sequence: Synthetic peptide
  Seed: LSEITKQEK (PIK3CA E545K)
LVEITKQEF

SEQ ID NO: 15813 - protein, 9 aa, Artificial Sequence
  Description of Artificial Sequence: Synthetic peptide
  Seed: LSEITKQEK (PIK3CA E545K)
LVEITKQEK

SEQ ID NO: 15814 - protein, 9 aa, Artificial Sequence
  Description of Artificial Sequence: Synthetic peptide
  Seed: LSEITKQEK (PIK3CA E545K)
LVEITKQEL

SEQ ID NO: 15815 - protein, 9 aa, Artificial Sequence
  Description of Artificial Sequence: Synthetic peptide
  Seed: LSEITKQEK (PIK3CA E545K)
LVEITKQEM

SEQ ID NO: 15816 - protein, 9 aa, Artificial Sequence
  Description of Artificial Sequence: Synthetic peptide
  Seed: LSEITKQEK (PIK3CA E545K)
LVEITKQER

SEQ ID NO: 15817 - protein, 9 aa, Artificial Sequence
  Description of Artificial Sequence: Synthetic peptide
  Seed: LSEITKQEK (PIK3CA E545K)
LVEITKQEY

SEQ ID NO: 15818 - protein, 9 aa, Artificial Sequence
  Description of Artificial Sequence: Synthetic peptide
  Seed: LSEITKQEK (PIK3CA E545K)
LWEITKQEF

SEQ ID NO: 15819 - protein, 9 aa, Artificial Sequence
  Description of Artificial Sequence: Synthetic peptide
  Seed: LSEITKQEK (PIK3CA E545K)
LWEITKQEY

SEQ ID NO: 15820 - protein, 9 aa, Artificial Sequence
  Description of Artificial Sequence: Synthetic peptide
  Seed: LSEITKQEK (PIK3CA E545K)
LYEITKQEF

SEQ ID NO: 15821 - protein, 9 aa, Artificial Sequence
  Description of Artificial Sequence: Synthetic peptide
  Seed: LSEITKQEK (PIK3CA E545K)
LYEITKQEL

SEQ ID NO: 15822 - protein, 9 aa, Artificial Sequence
  Description of Artificial Sequence: Synthetic peptide
  Seed: LSEITKQEK (PIK3CA E545K)
LYEITKQEM

SEQ ID NO: 15823 - protein, 9 aa, Artificial Sequence
  Description of Artificial Sequence: Synthetic peptide
  Seed: LSEITKQEK (PIK3CA E545K)
LYEITKQEY

SEQ ID NO: 15824 - protein, 9 aa, Artificial Sequence
  Description of Artificial Sequence: Synthetic peptide
  Seed: SEITKQEKD (PIK3CA E545K)
SDITKQEKA

SEQ ID NO: 15825 - protein, 9 aa, Artificial Sequence
  Description of Artificial Sequence: Synthetic peptide
  Seed: SEITKQEKD (PIK3CA E545K)
SDITKQEKC

SEQ ID NO: 15826 - protein, 11 aa, Artificial Sequence
  Description of Artificial Sequence: Synthetic peptide
  Seed: SEITKQEKDFL (PIK3CA E545K)
SDITKQEKDFW

SEQ ID NO: 15827 - protein, 10 aa, Artificial Sequence
  Description of Artificial Sequence: Synthetic peptide
  Seed: SEITKQEKDF (PIK3CA E545K)
SDITKQEKDW

SEQ ID NO: 15828 - protein, 9 aa, Artificial Sequence
  Description of Artificial Sequence: Synthetic peptide
  Seed: SEITKQEKD (PIK3CA E545K)
SDITKQEKI

SEQ ID NO: 15829 - protein, 9 aa, Artificial Sequence
  Description of Artificial Sequence: Synthetic peptide
  Seed: SEITKQEKD (PIK3CA E545K)
SDITKQEKL

SEQ ID NO: 15830 - protein, 9 aa, Artificial Sequence
  Description of Artificial Sequence: Synthetic peptide
  Seed: SEITKQEKD (PIK3CA E545K)
SDITKQEKM

SEQ ID NO: 15831 - protein, 9 aa, Artificial Sequence
  Description of Artificial Sequence: Synthetic peptide
  Seed: SEITKQEKD (PIK3CA E545K)
SDITKQEKP

SEQ ID NO: 15832 - protein, 9 aa, Artificial Sequence
  Description of Artificial Sequence: Synthetic peptide
  Seed: SEITKQEKD (PIK3CA E545K)
SDITKQEKT

SEQ ID NO: 15833 - protein, 9 aa, Artificial Sequence
  Description of Artificial Sequence: Synthetic peptide
  Seed: SEITKQEKD (PIK3CA E545K)
SDITKQEKV

SEQ ID NO: 15834 - protein, 9 aa, Artificial Sequence
  Description of Artificial Sequence: Synthetic peptide
  Seed: SEITKQEKD (PIK3CA E545K)
SEITKQEKC

SEQ ID NO: 15835 - protein, 10 aa, Artificial Sequence
  Description of Artificial Sequence: Synthetic peptide
  Seed: SEITKQEKDF (PIK3CA E545K)
SEITKQEKDA

SEQ ID NO: 15836 - protein, 10 aa, Artificial Sequence
  Description of Artificial Sequence: Synthetic peptide
  Seed: SEITKQEKDF (PIK3CA E545K)
SEITKQEKDC

SEQ ID NO: 15837 - protein, 11 aa, Artificial Sequence
  Description of Artificial Sequence: Synthetic peptide
  Seed: SEITKQEKDFL (PIK3CA E545K)
SEITKQEKDFA

SEQ ID NO: 15838 - protein, 11 aa, Artificial Sequence
  Description of Artificial Sequence: Synthetic peptide
  Seed: SEITKQEKDFL (PIK3CA E545K)
SEITKQEKDFC

SEQ ID NO: 15839 - protein, 11 aa, Artificial Sequence
  Description of Artificial Sequence: Synthetic peptide
  Seed: SEITKQEKDFL (PIK3CA E545K)
SEITKQEKDFF

SEQ ID NO: 15840 - protein, 11 aa, Artificial Sequence
  Description of Artificial Sequence: Synthetic peptide
  Seed: SEITKQEKDFL (PIK3CA E545K)
SEITKQEKDFI

SEQ ID NO: 15841 - protein, 11 aa, Artificial Sequence
  Description of Artificial Sequence: Synthetic peptide
  Seed: SEITKQEKDFL (PIK3CA E545K)
SEITKQEKDFM

SEQ ID NO: 15842 - protein, 11 aa, Artificial Sequence
  Description of Artificial Sequence: Synthetic peptide
  Seed: SEITKQEKDFL (PIK3CA E545K)
SEITKQEKDFP

SEQ ID NO: 15843 - protein, 11 aa, Artificial Sequence
  Description of Artificial Sequence: Synthetic peptide
  Seed: SEITKQEKDFL (PIK3CA E545K)
SEITKQEKDFT

SEQ ID NO: 15844 - protein, 11 aa, Artificial Sequence
  Description of Artificial Sequence: Synthetic peptide
  Seed: SEITKQEKDFL (PIK3CA E545K)
SEITKQEKDFV

SEQ ID NO: 15845 - protein, 11 aa, Artificial Sequence
  Description of Artificial Sequence: Synthetic peptide
  Seed: SEITKQEKDFL (PIK3CA E545K)
SEITKQEKDFY

SEQ ID NO: 15846 - protein, 10 aa, Artificial Sequence
  Description of Artificial Sequence: Synthetic peptide
  Seed: SEITKQEKDF (PIK3CA E545K)
SEITKQEKDI

SEQ ID NO: 15847 - protein, 10 aa, Artificial Sequence
  Description of Artificial Sequence: Synthetic peptide
  Seed: SEITKQEKDF (PIK3CA E545K)
SEITKQEKDL

SEQ ID NO: 15848 - protein, 10 aa, Artificial Sequence
  Description of Artificial Sequence: Synthetic peptide
  Seed: SEITKQEKDF (PIK3CA E545K)
SEITKQEKDM

SEQ ID NO: 15849 - protein, 10 aa, Artificial Sequence
  Description of Artificial Sequence: Synthetic peptide
  Seed: SEITKQEKDF (PIK3CA E545K)
SEITKQEKDP

SEQ ID NO: 15850 - protein, 10 aa, Artificial Sequence
  Description of Artificial Sequence: Synthetic peptide
  Seed: SEITKQEKDF (PIK3CA E545K)
SEITKQEKDT

SEQ ID NO: 15851 - protein, 10 aa, Artificial Sequence
  Description of Artificial Sequence: Synthetic peptide
  Seed: SEITKQEKDF (PIK3CA E545K)
SEITKQEKDV

SEQ ID NO: 15852 - protein, 9 aa, Artificial Sequence
  Description of Artificial Sequence: Synthetic peptide
  Seed: SEITKQEKD (PIK3CA E545K)
SEITKQEKE

SEQ ID NO: 15853 - protein, 9 aa, Artificial Sequence
  Description of Artificial Sequence: Synthetic peptide
  Seed: SEITKQEKD (PIK3CA E545K)
SEITKQEKF

SEQ ID NO: 15854 - protein, 9 aa, Artificial Sequence
  Description of Artificial Sequence: Synthetic peptide
  Seed: SEITKQEKD (PIK3CA E545K)
SEITKQEKG

SEQ ID NO: 15855 - protein, 9 aa, Artificial Sequence
  Description of Artificial Sequence: Synthetic peptide
  Seed: SEITKQEKD (PIK3CA E545K)
SEITKQEKI

SEQ ID NO: 15856 - protein, 9 aa, Artificial Sequence
  Description of Artificial Sequence: Synthetic peptide
  Seed: SEITKQEKD (PIK3CA E545K)
SEITKQEKK

SEQ ID NO: 15857 - protein, 9 aa, Artificial Sequence
  Description of Artificial Sequence: Synthetic peptide
  Seed: SEITKQEKD (PIK3CA E545K)
SEITKQEKL

SEQ ID NO: 15858 - protein, 9 aa, Artificial Sequence
  Description of Artificial Sequence: Synthetic peptide
  Seed: SEITKQEKD (PIK3CA E545K)
SEITKQEKM

SEQ ID NO: 15859 - protein, 9 aa, Artificial Sequence
  Description of Artificial Sequence: Synthetic peptide
  Seed: SEITKQEKD (PIK3CA E545K)
SEITKQEKN

SEQ ID NO: 15860 - protein, 9 aa, Artificial Sequence
  Description of Artificial Sequence: Synthetic peptide
  Seed: SEITKQEKD (PIK3CA E545K)
SEITKQEKP

SEQ ID NO: 15861 - protein, 9 aa, Artificial Sequence
  Description of Artificial Sequence: Synthetic peptide
  Seed: SEITKQEKD (PIK3CA E545K)
SEITKQEKQ

SEQ ID NO: 15862 - protein, 9 aa, Artificial Sequence
  Description of Artificial Sequence: Synthetic peptide
  Seed: SEITKQEKD (PIK3CA E545K)
SEITKQEKR

SEQ ID NO: 15863 - protein, 9 aa, Artificial Sequence
  Description of Artificial Sequence: Synthetic peptide
  Seed: SEITKQEKD (PIK3CA E545K)
SEITKQEKS

SEQ ID NO: 15864 - protein, 9 aa, Artificial Sequence
  Description of Artificial Sequence: Synthetic peptide
  Seed: SEITKQEKD (PIK3CA E545K)
SEITKQEKT

SEQ ID NO: 15865 - protein, 9 aa, Artificial Sequence
  Description of Artificial Sequence: Synthetic peptide
  Seed: SEITKQEKD (PIK3CA E545K)
SEITKQEKW

SEQ ID NO: 15866 - protein, 9 aa, Artificial Sequence
  Description of Artificial Sequence: Synthetic peptide
  Seed: SEITKQEKD (PIK3CA E545K)
SEITKQEKY

SEQ ID NO: 15867 - protein, 9 aa, Artificial Sequence
  Description of Artificial Sequence: Synthetic peptide
  Seed: SEITKQEKD (PIK3CA E545K)
SQITKQEKA

SEQ ID NO: 15868 - protein, 9 aa, Artificial Sequence
  Description of Artificial Sequence: Synthetic peptide
  Seed: SEITKQEKD (PIK3CA E545K)
SQITKQEKC

SEQ ID NO: 15869 - protein, 10 aa, Artificial Sequence
  Description of Artificial Sequence: Synthetic peptide
  Seed: SEITKQEKDF (PIK3CA E545K)
SQITKQEKDF

SEQ ID NO: 15870 - protein, 11 aa, Artificial Sequence
  Description of Artificial Sequence: Synthetic peptide
  Seed: SEITKQEKDFL (PIK3CA E545K)
SQITKQEKDFF

SEQ ID NO: 15871 - protein, 11 aa, Artificial Sequence
  Description of Artificial Sequence: Synthetic peptide
  Seed: SEITKQEKDFL (PIK3CA E545K)
SQITKQEKDFW

SEQ ID NO: 15872 - protein, 11 aa, Artificial Sequence
  Description of Artificial Sequence: Synthetic peptide
  Seed: SEITKQEKDFL (PIK3CA E545K)
SQITKQEKDFY

SEQ ID NO: 15873 - protein, 10 aa, Artificial Sequence
  Description of Artificial Sequence: Synthetic peptide
  Seed: SEITKQEKDF (PIK3CA E545K)
SQITKQEKDW

SEQ ID NO: 15874 - protein, 10 aa, Artificial Sequence
  Description of Artificial Sequence: Synthetic peptide
  Seed: SEITKQEKDF (PIK3CA E545K)
SQITKQEKDY

SEQ ID NO: 15875 - protein, 9 aa, Artificial Sequence
  Description of Artificial Sequence: Synthetic peptide
  Seed: SEITKQEKD (PIK3CA E545K)
SQITKQEKI

SEQ ID NO: 15876 - protein, 9 aa, Artificial Sequence
  Description of Artificial Sequence: Synthetic peptide
  Seed: SEITKQEKD (PIK3CA E545K)
SQITKQEKL

SEQ ID NO: 15877 - protein, 9 aa, Artificial Sequence
  Description of Artificial Sequence: Synthetic peptide
  Seed: SEITKQEKD (PIK3CA E545K)
SQITKQEKV

SEQ ID NO: 15878 - protein, 11 aa, Artificial Sequence
  Description of Artificial Sequence: Synthetic peptide
  Seed: TRDPLSEITKQ (PIK3CA E545K)
TEDPLSEITKK

SEQ ID NO: 15879 - protein, 11 aa, Artificial Sequence
  Description of Artificial Sequence: Synthetic peptide
  Seed: TRDPLSEITKQ (PIK3CA E545K)
TFDPLSEITKF

SEQ ID NO: 15880 - protein, 11 aa, Artificial Sequence
  Description of Artificial Sequence: Synthetic peptide
  Seed: TRDPLSEITKQ (PIK3CA E545K)
TFDPLSEITKL

SEQ ID NO: 15881 - protein, 11 aa, Artificial Sequence
  Description of Artificial Sequence: Synthetic peptide
  Seed: TRDPLSEITKQ (PIK3CA E545K)
TGDPLSEITKK

SEQ ID NO: 15882 - protein, 11 aa, Artificial Sequence
  Description of Artificial Sequence: Synthetic peptide
  Seed: TRDPLSEITKQ (PIK3CA E545K)
TKDPLSEITKK

SEQ ID NO: 15883 - protein, 11 aa, Artificial Sequence
  Description of Artificial Sequence: Synthetic peptide
  Seed: TRDPLSEITKQ (PIK3CA E545K)
TQDPLSEITKK

SEQ ID NO: 15884 - protein, 11 aa, Artificial Sequence
  Description of Artificial Sequence: Synthetic peptide
  Seed: TRDPLSEITKQ (PIK3CA E545K)
TRDPLSEITKF

SEQ ID NO: 15885 - protein, 11 aa, Artificial Sequence
  Description of Artificial Sequence: Synthetic peptide
  Seed: TRDPLSEITKQ (PIK3CA E545K)
TRDPLSEITKH

SEQ ID NO: 15886 - protein, 11 aa, Artificial Sequence
  Description of Artificial Sequence: Synthetic peptide
  Seed: TRDPLSEITKQ (PIK3CA E545K)
TRDPLSEITKI

SEQ ID NO: 15887 - protein, 11 aa, Artificial Sequence
  Description of Artificial Sequence: Synthetic peptide
  Seed: TRDPLSEITKQ (PIK3CA E545K)
TRDPLSEITKK

SEQ ID NO: 15888 - protein, 11 aa, Artificial Sequence
  Description of Artificial Sequence: Synthetic peptide
  Seed: TRDPLSEITKQ (PIK3CA E545K)
TRDPLSEITKL

SEQ ID NO: 15889 - protein, 11 aa, Artificial Sequence
  Description of Artificial Sequence: Synthetic peptide
  Seed: TRDPLSEITKQ (PIK3CA E545K)
TRDPLSEITKM

SEQ ID NO: 15890 - protein, 11 aa, Artificial Sequence
  Description of Artificial Sequence: Synthetic peptide
  Seed: TRDPLSEITKQ (PIK3CA E545K)
TRDPLSEITKR

SEQ ID NO: 15891 - protein, 11 aa, Artificial Sequence
  Description of Artificial Sequence: Synthetic peptide
  Seed: TRDPLSEITKQ (PIK3CA E545K)
TRDPLSEITKV

SEQ ID NO: 15892 - protein, 11 aa, Artificial Sequence
  Description of Artificial Sequence: Synthetic peptide
  Seed: TRDPLSEITKQ (PIK3CA E545K)
TRDPLSEITKW

SEQ ID NO: 15893 - protein, 11 aa, Artificial Sequence
  Description of Artificial Sequence: Synthetic peptide
  Seed: TRDPLSEITKQ (PIK3CA E545K)
TRDPLSEITKY

SEQ ID NO: 15894 - protein, 11 aa, Artificial Sequence
  Description of Artificial Sequence: Synthetic peptide
  Seed: TRDPLSEITKQ (PIK3CA E545K)
TWDPLSEITKF

SEQ ID NO: 15895 - protein, 11 aa, Artificial Sequence
  Description of Artificial Sequence: Synthetic peptide
  Seed: TRDPLSEITKQ (PIK3CA E545K)
TWDPLSEITKL

SEQ ID NO: 15896 - protein, 11 aa, Artificial Sequence
  Description of Artificial Sequence: Synthetic peptide
  Seed: TRDPLSEITKQ (PIK3CA E545K)
TWDPLSEITKM

SEQ ID NO: 15897 - protein, 11 aa, Artificial Sequence
  Description of Artificial Sequence: Synthetic peptide
  Seed: TRDPLSEITKQ (PIK3CA E545K)
TYDPLSEITKF

SEQ ID NO: 15898 - protein, 11 aa, Artificial Sequence
  Description of Artificial Sequence: Synthetic peptide
  Seed: TRDPLSEITKQ (PIK3CA E545K)
TYDPLSEITKL

SEQ ID NO: 15899 - protein, 11 aa, Homo sapiens
  Native (PIK3CA E545K)
EITKQEKDFLW

SEQ ID NO: 15900 - protein, 11 aa, Homo sapiens
  Native (PIK3CA E545K)
ITKQEKDFLWS

SEQ ID NO: 15901 - protein, 11 aa, Homo sapiens
  Native (PIK3CA E545K)
KQEKDFLWSHR

SEQ ID NO: 15902 - protein, 10 aa, Homo sapiens
  Native (PIK3CA E545K)
SEITKQEKDF

SEQ ID NO: 15903 - protein, 9 aa, Homo sapiens
  Native (PIK3CA E545K)
ITKQEKDFL

SEQ ID NO: 15904 - protein, 9 aa, Homo sapiens
  Native (PIK3CA E545K)
LSEITKQEK

SEQ ID NO: 15905 - protein, 9 aa, Homo sapiens
  Native (PIK3CA E545K)
SEITKQEKD

SEQ ID NO: 15906 - protein, 11 aa, Homo sapiens
  Native (PIK3CA E545K)
SEITKQEKDFL

SEQ ID NO: 15907 - protein, 11 aa, Homo sapiens
  Native (PIK3CA E545K)
TRDPLSEITKQ

SEQ ID NO: 15908 - protein, 10 aa, Artificial Sequence
  Description of Artificial Sequence: Synthetic peptide
  Seed: DARHGGWTTK (PIK3CA H1047R)
DARHGGWTTR

SEQ ID NO: 15909 - protein, 10 aa, Artificial Sequence
  Description of Artificial Sequence: Synthetic peptide
  Seed: DARHGGWTTK (PIK3CA H1047R)
DIRHGGWTTK

SEQ ID NO: 15910 - protein, 10 aa, Artificial Sequence
  Description of Artificial Sequence: Synthetic peptide
  Seed: DARHGGWTTK (PIK3CA H1047R)
DIRHGGWTTR

SEQ ID NO: 15911 - protein, 10 aa, Artificial Sequence
  Description of Artificial Sequence: Synthetic peptide
  Seed: DARHGGWTTK (PIK3CA H1047R)
DLRHGGWTTR

SEQ ID NO: 15912 - protein, 10 aa, Artificial Sequence
  Description of Artificial Sequence: Synthetic peptide
  Seed: DARHGGWTTK (PIK3CA H1047R)
DMRHGGWTTR

SEQ ID NO: 15913 - protein, 10 aa, Artificial Sequence
  Description of Artificial Sequence: Synthetic peptide
  Seed: DARHGGWTTK (PIK3CA H1047R)
DSRHGGWTTK

SEQ ID NO: 15914 - protein, 10 aa, Artificial Sequence
  Description of Artificial Sequence: Synthetic peptide
  Seed: DARHGGWTTK (PIK3CA H1047R)
DSRHGGWTTR

SEQ ID NO: 15915 - protein, 10 aa, Artificial Sequence
  Description of Artificial Sequence: Synthetic peptide
  Seed: DARHGGWTTK (PIK3CA H1047R)
DTRHGGWTTK

SEQ ID NO: 15916 - protein, 9 aa, Artificial Sequence
  Description of Artificial Sequence: Synthetic peptide
  Seed: KQMNDARHG (PIK3CA H1047R)
KAMNDARHF

SEQ ID NO: 15917 - protein, 9 aa, Artificial Sequence
  Description of Artificial Sequence: Synthetic peptide
  Seed: KQMNDARHG (PIK3CA H1047R)
KAMNDARHL

SEQ ID NO: 15918 - protein, 9 aa, Artificial Sequence
  Description of Artificial Sequence: Synthetic peptide
  Seed: KQMNDARHG (PIK3CA H1047R)
KAMNDARHM

SEQ ID NO: 15919 - protein, 9 aa, Artificial Sequence
  Description of Artificial Sequence: Synthetic peptide
  Seed: KQMNDARHG (PIK3CA H1047R)
KAMNDARHY

SEQ ID NO: 15920 - protein, 9 aa, Artificial Sequence
  Description of Artificial Sequence: Synthetic peptide
  Seed: KQMNDARHG (PIK3CA H1047R)
KEMNDARHF

SEQ ID NO: 15921 - protein, 9 aa, Artificial Sequence
  Description of Artificial Sequence: Synthetic peptide
  Seed: KQMNDARHG (PIK3CA H1047R)
KEMNDARHL

SEQ ID NO: 15922 - protein, 9 aa, Artificial Sequence
  Description of Artificial Sequence: Synthetic peptide
  Seed: KQMNDARHG (PIK3CA H1047R)
KEMNDARHM

SEQ ID NO: 15923 - protein, 9 aa, Artificial Sequence
  Description of Artificial Sequence: Synthetic peptide
  Seed: KQMNDARHG (PIK3CA H1047R)
KEMNDARHY

SEQ ID NO: 15924 - protein, 9 aa, Artificial Sequence
  Description of Artificial Sequence: Synthetic peptide
  Seed: KQMNDARHG (PIK3CA H1047R)
KFMNDARHF

SEQ ID NO: 15925 - protein, 9 aa, Artificial Sequence
  Description of Artificial Sequence: Synthetic peptide
  Seed: KQMNDARHG (PIK3CA H1047R)
KFMNDARHY

SEQ ID NO: 15926 - protein, 9 aa, Artificial Sequence
  Description of Artificial Sequence: Synthetic peptide
  Seed: KQMNDARHG (PIK3CA H1047R)
KGMNDARHF

SEQ ID NO: 15927 - protein, 9 aa, Artificial Sequence
  Description of Artificial Sequence: Synthetic peptide
  Seed: KQMNDARHG (PIK3CA H1047R)
KGMNDARHY

SEQ ID NO: 15928 - protein, 9 aa, Artificial Sequence
  Description of Artificial Sequence: Synthetic peptide
  Seed: KQMNDARHG (PIK3CA H1047R)
KHMNDARHF

SEQ ID NO: 15929 - protein, 9 aa, Artificial Sequence
  Description of Artificial Sequence: Synthetic peptide
  Seed: KQMNDARHG (PIK3CA H1047R)
KHMNDARHL

SEQ ID NO: 15930 - protein, 9 aa, Artificial Sequence
  Description of Artificial Sequence: Synthetic peptide
  Seed: KQMNDARHG (PIK3CA H1047R)
KHMNDARHM

SEQ ID NO: 15931 - protein, 9 aa, Artificial Sequence
  Description of Artificial Sequence: Synthetic peptide
  Seed: KQMNDARHG (PIK3CA H1047R)
KHMNDARHY

SEQ ID NO: 15932 - protein, 9 aa, Artificial Sequence
  Description of Artificial Sequence: Synthetic peptide
  Seed: KQMNDARHG (PIK3CA H1047R)
KIMNDARHF

SEQ ID NO: 15933 - protein, 9 aa, Artificial Sequence
  Description of Artificial Sequence: Synthetic peptide
  Seed: KQMNDARHG (PIK3CA H1047R)
KIMNDARHM

SEQ ID NO: 15934 - protein, 9 aa, Artificial Sequence
  Description of Artificial Sequence: Synthetic peptide
  Seed: KQMNDARHG (PIK3CA H1047R)
KIMNDARHY

SEQ ID NO: 15935 - protein, 9 aa, Artificial Sequence
  Description of Artificial Sequence: Synthetic peptide
  Seed: KQMNDARHG (PIK3CA H1047R)
KKMNDARHF

SEQ ID NO: 15936 - protein, 9 aa, Artificial Sequence
  Description of Artificial Sequence: Synthetic peptide
  Seed: KQMNDARHG (PIK3CA H1047R)
KKMNDARHI

SEQ ID NO: 15937 - protein, 9 aa, Artificial Sequence
  Description of Artificial Sequence: Synthetic peptide
  Seed: KQMNDARHG (PIK3CA H1047R)
KKMNDARHL

SEQ ID NO: 15938 - protein, 9 aa, Artificial Sequence
  Description of Artificial Sequence: Synthetic peptide
  Seed: KQMNDARHG (PIK3CA H1047R)
KKMNDARHM

SEQ ID NO: 15939 - protein, 9 aa, Artificial Sequence
  Description of Artificial Sequence: Synthetic peptide
  Seed: KQMNDARHG (PIK3CA H1047R)
KKMNDARHV

SEQ ID NO: 15940 - protein, 9 aa, Artificial Sequence
  Description of Artificial Sequence: Synthetic peptide
  Seed: KQMNDARHG (PIK3CA H1047R)
KKMNDARHY

SEQ ID NO: 15941 - protein, 9 aa, Artificial Sequence
  Description of Artificial Sequence: Synthetic peptide
  Seed: KQMNDARHG (PIK3CA H1047R)
KLMNDARHF

SEQ ID NO: 15942 - protein, 9 aa, Artificial Sequence
  Description of Artificial Sequence: Synthetic peptide
  Seed: KQMNDARHG (PIK3CA H1047R)
KLMNDARHL

SEQ ID NO: 15943 - protein, 9 aa, Artificial Sequence
  Description of Artificial Sequence: Synthetic peptide
  Seed: KQMNDARHG (PIK3CA H1047R)
KLMNDARHM

SEQ ID NO: 15944 - protein, 9 aa, Artificial Sequence
  Description of Artificial Sequence: Synthetic peptide
  Seed: KQMNDARHG (PIK3CA H1047R)
KLMNDARHY

SEQ ID NO: 15945 - protein, 9 aa, Artificial Sequence
  Description of Artificial Sequence: Synthetic peptide
  Seed: KQMNDARHG (PIK3CA H1047R)
KMMNDARHA

SEQ ID NO: 15946 - protein, 9 aa, Artificial Sequence
  Description of Artificial Sequence: Synthetic peptide
  Seed: KQMNDARHG (PIK3CA H1047R)
KMMNDARHF

SEQ ID NO: 15947 - protein, 9 aa, Artificial Sequence
  Description of Artificial Sequence: Synthetic peptide
  Seed: KQMNDARHG (PIK3CA H1047R)
KMMNDARHH

SEQ ID NO: 15948 - protein, 9 aa, Artificial Sequence
  Description of Artificial Sequence: Synthetic peptide
  Seed: KQMNDARHG (PIK3CA H1047R)
KMMNDARHI

SEQ ID NO: 15949 - protein, 9 aa, Artificial Sequence
  Description of Artificial Sequence: Synthetic peptide
  Seed: KQMNDARHG (PIK3CA H1047R)
KMMNDARHL

SEQ ID NO: 15950 - protein, 9 aa, Artificial Sequence
  Description of Artificial Sequence: Synthetic peptide
  Seed: KQMNDARHG (PIK3CA H1047R)
KMMNDARHM

SEQ ID NO: 15951 - protein, 9 aa, Artificial Sequence
  Description of Artificial Sequence: Synthetic peptide
  Seed: KQMNDARHG (PIK3CA H1047R)
KMMNDARHV

SEQ ID NO: 15952 - protein, 9 aa, Artificial Sequence
  Description of Artificial Sequence: Synthetic peptide
  Seed: KQMNDARHG (PIK3CA H1047R)
KMMNDARHW

SEQ ID NO: 15953 - protein, 9 aa, Artificial Sequence
  Description of Artificial Sequence: Synthetic peptide
  Seed: KQMNDARHG (PIK3CA H1047R)
KMMNDARHY

SEQ ID NO: 15954 - protein, 9 aa, Artificial Sequence
  Description of Artificial Sequence: Synthetic peptide
  Seed: KQMNDARHG (PIK3CA H1047R)
KNMNDARHF

SEQ ID NO: 15955 - protein, 9 aa, Artificial Sequence
  Description of Artificial Sequence: Synthetic peptide
  Seed: KQMNDARHG (PIK3CA H1047R)
KNMNDARHM

SEQ ID NO: 15956 - protein, 9 aa, Artificial Sequence
  Description of Artificial Sequence: Synthetic peptide
  Seed: KQMNDARHG (PIK3CA H1047R)
KNMNDARHY

SEQ ID NO: 15957 - protein, 9 aa, Artificial Sequence
  Description of Artificial Sequence: Synthetic peptide
  Seed: KQMNDARHG (PIK3CA H1047R)
KQMNDARHA

SEQ ID NO: 15958 - protein, 9 aa, Artificial Sequence
  Description of Artificial Sequence: Synthetic peptide
  Seed: KQMNDARHG (PIK3CA H1047R)
KQMNDARHC

SEQ ID NO: 15959 - protein, 9 aa, Artificial Sequence
  Description of Artificial Sequence: Synthetic peptide
  Seed: KQMNDARHG (PIK3CA H1047R)
KQMNDARHH

SEQ ID NO: 15960 - protein, 9 aa, Artificial Sequence
  Description of Artificial Sequence: Synthetic peptide
  Seed: KQMNDARHG (PIK3CA H1047R)
KQMNDARHI

SEQ ID NO: 15961 - protein, 9 aa, Artificial Sequence
  Description of Artificial Sequence: Synthetic peptide
  Seed: KQMNDARHG (PIK3CA H1047R)
KQMNDARHL

SEQ ID NO: 15962 - protein, 9 aa, Artificial Sequence
  Description of Artificial Sequence: Synthetic peptide
  Seed: KQMNDARHG (PIK3CA H1047R)
KQMNDARHM

SEQ ID NO: 15963 - protein, 9 aa, Artificial Sequence
  Description of Artificial Sequence: Synthetic peptide
  Seed: KQMNDARHG (PIK3CA H1047R)
KQMNDARHV

SEQ ID NO: 15964 - protein, 9 aa, Artificial Sequence
  Description of Artificial Sequence: Synthetic peptide
  Seed: KQMNDARHG (PIK3CA H1047R)
KQMNDARHW

SEQ ID NO: 15965 - protein, 9 aa, Artificial Sequence
  Description of Artificial Sequence: Synthetic peptide
  Seed: KQMNDARHG (PIK3CA H1047R)
KQMNDARHY

SEQ ID NO: 15966 - protein, 9 aa, Artificial Sequence
  Description of Artificial Sequence: Synthetic peptide
  Seed: KQMNDARHG (PIK3CA H1047R)
KRMNDARHM

SEQ ID NO: 15967 - protein, 9 aa, Artificial Sequence
  Description of Artificial Sequence: Synthetic peptide
  Seed: KQMNDARHG (PIK3CA H1047R)
KRMNDARHY

SEQ ID NO: 15968 - protein, 9 aa, Artificial Sequence
  Description of Artificial Sequence: Synthetic peptide
  Seed: KQMNDARHG (PIK3CA H1047R)
KSMNDARHF

SEQ ID NO: 15969 - protein, 9 aa, Artificial Sequence
  Description of Artificial Sequence: Synthetic peptide
  Seed: KQMNDARHG (PIK3CA H1047R)
KSMNDARHM

SEQ ID NO: 15970 - protein, 9 aa, Artificial Sequence
  Description of Artificial Sequence: Synthetic peptide
  Seed: KQMNDARHG (PIK3CA H1047R)
KSMNDARHY

SEQ ID NO: 15971 - protein, 9 aa, Artificial Sequence
  Description of Artificial Sequence: Synthetic peptide
  Seed: KQMNDARHG (PIK3CA H1047R)
KTMNDARHF

SEQ ID NO: 15972 - protein, 9 aa, Artificial Sequence
  Description of Artificial Sequence: Synthetic peptide
  Seed: KQMNDARHG (PIK3CA H1047R)
KTMNDARHM

SEQ ID NO: 15973 - protein, 9 aa, Artificial Sequence
  Description of Artificial Sequence: Synthetic peptide
  Seed: KQMNDARHG (PIK3CA H1047R)
KTMNDARHY

SEQ ID NO: 15974 - protein, 9 aa, Artificial Sequence
  Description of Artificial Sequence: Synthetic peptide
  Seed: KQMNDARHG (PIK3CA H1047R)
KVMNDARHF

SEQ ID NO: 15975 - protein, 9 aa, Artificial Sequence
  Description of Artificial Sequence: Synthetic peptide
  Seed: KQMNDARHG (PIK3CA H1047R)
KVMNDARHM

SEQ ID NO: 15976 - protein, 9 aa, Artificial Sequence
  Description of Artificial Sequence: Synthetic peptide
  Seed: KQMNDARHG (PIK3CA H1047R)
KYMNDARHF

SEQ ID NO: 15977 - protein, 9 aa, Artificial Sequence
  Description of Artificial Sequence: Synthetic peptide
  Seed: KQMNDARHG (PIK3CA H1047R)
KYMNDARHM

SEQ ID NO: 15978 - protein, 9 aa, Artificial Sequence
  Description of Artificial Sequence: Synthetic peptide
  Seed: KQMNDARHG (PIK3CA H1047R)
KYMNDARHY

SEQ ID NO: 15979 - protein, 9 aa, Artificial Sequence
  Description of Artificial Sequence: Synthetic peptide
  Seed: RHGGWTTKM (PIK3CA H1047R)
RAGGWTTKF

SEQ ID NO: 15980 - protein, 9 aa, Artificial Sequence
  Description of Artificial Sequence: Synthetic peptide
  Seed: RHGGWTTKM (PIK3CA H1047R)
RAGGWTTKM

SEQ ID NO: 15981 - protein, 9 aa, Artificial Sequence
  Description of Artificial Sequence: Synthetic peptide
  Seed: RHGGWTTKM (PIK3CA H1047R)
RAGGWTTKY

SEQ ID NO: 15982 - protein, 9 aa, Artificial Sequence
  Description of Artificial Sequence: Synthetic peptide
  Seed: RHGGWTTKM (PIK3CA H1047R)
REGGWTTKF

SEQ ID NO: 15983 - protein, 9 aa, Artificial Sequence
  Description of Artificial Sequence: Synthetic peptide
  Seed: RHGGWTTKM (PIK3CA H1047R)
REGGWTTKM

SEQ ID NO: 15984 - protein, 9 aa, Artificial Sequence
  Description of Artificial Sequence: Synthetic peptide
  Seed: RHGGWTTKM (PIK3CA H1047R)
REGGWTTKY

SEQ ID NO: 15985 - protein, 9 aa, Artificial Sequence
  Description of Artificial Sequence: Synthetic peptide
  Seed: RHGGWTTKM (PIK3CA H1047R)
RHGGWTTKF

SEQ ID NO: 15986 - protein, 9 aa, Artificial Sequence
  Description of Artificial Sequence: Synthetic peptide
  Seed: RHGGWTTKM (PIK3CA H1047R)
RHGGWTTKY

SEQ ID NO: 15987 - protein, 9 aa, Artificial Sequence
  Description of Artificial Sequence: Synthetic peptide
  Seed: RHGGWTTKM (PIK3CA H1047R)
RIGGWTTKF

SEQ ID NO: 15988 - protein, 9 aa, Artificial Sequence
  Description of Artificial Sequence: Synthetic peptide
  Seed: RHGGWTTKM (PIK3CA H1047R)
RKGGWTTKF

SEQ ID NO: 15989 - protein, 9 aa, Artificial Sequence
  Description of Artificial Sequence: Synthetic peptide
  Seed: RHGGWTTKM (PIK3CA H1047R)
RKGGWTTKL

SEQ ID NO: 15990 - protein, 9 aa, Artificial Sequence
  Description of Artificial Sequence: Synthetic peptide
  Seed: RHGGWTTKM (PIK3CA H1047R)
RKGGWTTKM

SEQ ID NO: 15991 - protein, 9 aa, Artificial Sequence
  Description of Artificial Sequence: Synthetic peptide
  Seed: RHGGWTTKM (PIK3CA H1047R)
RKGGWTTKY

SEQ ID NO: 15992 - protein, 9 aa, Artificial Sequence
  Description of Artificial Sequence: Synthetic peptide
  Seed: RHGGWTTKM (PIK3CA H1047R)
RLGGWTTKF

SEQ ID NO: 15993 - protein, 9 aa, Artificial Sequence
  Description of Artificial Sequence: Synthetic peptide
  Seed: RHGGWTTKM (PIK3CA H1047R)
RLGGWTTKY

SEQ ID NO: 15994 - protein, 9 aa, Artificial Sequence
  Description of Artificial Sequence: Synthetic peptide
  Seed: RHGGWTTKM (PIK3CA H1047R)
RMGGWTTKF

SEQ ID NO: 15995 - protein, 9 aa, Artificial Sequence
  Description of Artificial Sequence: Synthetic peptide
  Seed: RHGGWTTKM (PIK3CA H1047R)
RMGGWTTKL

SEQ ID NO: 15996 - protein, 9 aa, Artificial Sequence
  Description of Artificial Sequence: Synthetic peptide
  Seed: RHGGWTTKM (PIK3CA H1047R)
RMGGWTTKM

SEQ ID NO: 15997 - protein, 9 aa, Artificial Sequence
  Description of Artificial Sequence: Synthetic peptide
  Seed: RHGGWTTKM (PIK3CA H1047R)
RNGGWTTKF

SEQ ID NO: 15998 - protein, 9 aa, Artificial Sequence
  Description of Artificial Sequence: Synthetic peptide
  Seed: RHGGWTTKM (PIK3CA H1047R)
RQGGWTTKF

SEQ ID NO: 15999 - protein, 9 aa, Artificial Sequence
  Description of Artificial Sequence: Synthetic peptide
  Seed: RHGGWTTKM (PIK3CA H1047R)
RQGGWTTKH

SEQ ID NO: 16000 - protein, 9 aa, Artificial Sequence
  Description of Artificial Sequence: Synthetic peptide
  Seed: RHGGWTTKM (PIK3CA H1047R)
RQGGWTTKI

SEQ ID NO: 16001 - protein, 9 aa, Artificial Sequence
  Description of Artificial Sequence: Synthetic peptide
  Seed: RHGGWTTKM (PIK3CA H1047R)
RQGGWTTKL

SEQ ID NO: 16002 - protein, 9 aa, Artificial Sequence
  Description of Artificial Sequence: Synthetic peptide
  Seed: RHGGWTTKM (PIK3CA H1047R)
RQGGWTTKW

SEQ ID NO: 16003 - protein, 9 aa, Artificial Sequence
  Description of Artificial Sequence: Synthetic peptide
  Seed: RHGGWTTKM (PIK3CA H1047R)
RQGGWTTKY

SEQ ID NO: 16004 - protein, 9 aa, Artificial Sequence
  Description of Artificial Sequence: Synthetic peptide
  Seed: RHGGWTTKM (PIK3CA H1047R)
RSGGWTTKF

SEQ ID NO: 16005 - protein, 9 aa, Artificial Sequence
  Description of Artificial Sequence: Synthetic peptide
  Seed: RHGGWTTKM (PIK3CA H1047R)
RSGGWTTKY

SEQ ID NO: 16006 - protein, 9 aa, Artificial Sequence
  Description of Artificial Sequence: Synthetic peptide
  Seed: RHGGWTTKM (PIK3CA H1047R)
RTGGWTTKF

SEQ ID NO: 16007 - protein, 9 aa, Artificial Sequence
  Description of Artificial Sequence: Synthetic peptide
  Seed: RHGGWTTKM (PIK3CA H1047R)
RVGGWTTKF

SEQ ID NO: 16008 - protein, 9 aa, Artificial Sequence
  Description of Artificial Sequence: Synthetic peptide
  Seed: RHGGWTTKM (PIK3CA H1047R)
RVGGWTTKY

SEQ ID NO: 16009 - protein, 10 aa, Artificial Sequence
  Description of Artificial Sequence: Synthetic peptide
  Seed: DARHGGWTTK (PIK3CA H1047R)
DARHGGWTTY

SEQ ID NO: 16010 - protein, 10 aa, Artificial Sequence
  Description of Artificial Sequence: Synthetic peptide
  Seed: DARHGGWTTK (PIK3CA H1047R)
DCRHGGWTTK

SEQ ID NO: 16011 - protein, 10 aa, Artificial Sequence
  Description of Artificial Sequence: Synthetic peptide
  Seed: DARHGGWTTK (PIK3CA H1047R)
DCRHGGWTTR

SEQ ID NO: 16012 - protein, 10 aa, Artificial Sequence
  Description of Artificial Sequence: Synthetic peptide
  Seed: DARHGGWTTK (PIK3CA H1047R)
DDRHGGWTTR

SEQ ID NO: 16013 - protein, 10 aa, Artificial Sequence
  Description of Artificial Sequence: Synthetic peptide
  Seed: DARHGGWTTK (PIK3CA H1047R)
DERHGGWTTR

SEQ ID NO: 16014 - protein, 10 aa, Artificial Sequence
  Description of Artificial Sequence: Synthetic peptide
  Seed: DARHGGWTTK (PIK3CA H1047R)
DFRHGGWTTK

SEQ ID NO: 16015 - protein, 10 aa, Artificial Sequence
  Description of Artificial Sequence: Synthetic peptide
  Seed: DARHGGWTTK (PIK3CA H1047R)
DFRHGGWTTR

SEQ ID NO: 16016 - protein, 10 aa, Artificial Sequence
  Description of Artificial Sequence: Synthetic peptide
  Seed: DARHGGWTTK (PIK3CA H1047R)
DGRHGGWTTK

SEQ ID NO: 16017 - protein, 10 aa, Artificial Sequence
  Description of Artificial Sequence: Synthetic peptide
  Seed: DARHGGWTTK (PIK3CA H1047R)
DGRHGGWTTR

SEQ ID NO: 16018 - protein, 10 aa, Artificial Sequence
  Description of Artificial Sequence: Synthetic peptide
  Seed: DARHGGWTTK (PIK3CA H1047R)
DHRHGGWTTR

SEQ ID NO: 16019 - protein, 10 aa, Artificial Sequence
  Description of Artificial Sequence: Synthetic peptide
  Seed: DARHGGWTTK (PIK3CA H1047R)
DIRHGGWTTM

SEQ ID NO: 16020 - protein, 10 aa, Artificial Sequence
  Description of Artificial Sequence: Synthetic peptide
  Seed: DARHGGWTTK (PIK3CA H1047R)
DIRHGGWTTY

SEQ ID NO: 16021 - protein, 10 aa, Artificial Sequence
  Description of Artificial Sequence: Synthetic peptide
  Seed: DARHGGWTTK (PIK3CA H1047R)
DKRHGGWTTR

SEQ ID NO: 16022 - protein, 10 aa, Artificial Sequence
  Description of Artificial Sequence: Synthetic peptide
  Seed: DARHGGWTTK (PIK3CA H1047R)
DLRHGGWTTK

SEQ ID NO: 16023 - protein, 10 aa, Artificial Sequence
  Description of Artificial Sequence: Synthetic peptide
  Seed: DARHGGWTTK (PIK3CA H1047R)
DMRHGGWTTK

SEQ ID NO: 16024 - protein, 10 aa, Artificial Sequence
  Description of Artificial Sequence: Synthetic peptide
  Seed: DARHGGWTTK (PIK3CA H1047R)
DNRHGGWTTK

SEQ ID NO: 16025 - protein, 10 aa, Artificial Sequence
  Description of Artificial Sequence: Synthetic peptide
  Seed: DARHGGWTTK (PIK3CA H1047R)
DNRHGGWTTR

SEQ ID NO: 16026 - protein, 10 aa, Artificial Sequence
  Description of Artificial Sequence: Synthetic peptide
  Seed: DARHGGWTTK (PIK3CA H1047R)
DPRHGGWTTR

SEQ ID NO: 16027 - protein, 10 aa, Artificial Sequence
  Description of Artificial Sequence: Synthetic peptide
  Seed: DARHGGWTTK (PIK3CA H1047R)
DQRHGGWTTK

SEQ ID NO: 16028 - protein, 10 aa, Artificial Sequence
  Description of Artificial Sequence: Synthetic peptide
  Seed: DARHGGWTTK (PIK3CA H1047R)
DQRHGGWTTR

SEQ ID NO: 16029 - protein, 10 aa, Artificial Sequence
  Description of Artificial Sequence: Synthetic peptide
  Seed: DARHGGWTTK (PIK3CA H1047R)
DSRHGGWTTY

SEQ ID NO: 16030 - protein, 10 aa, Artificial Sequence
  Description of Artificial Sequence: Synthetic peptide
  Seed: DARHGGWTTK (PIK3CA H1047R)
DTRHGGWTTF

SEQ ID NO: 16031 - protein, 10 aa, Artificial Sequence
  Description of Artificial Sequence: Synthetic peptide
  Seed: DARHGGWTTK (PIK3CA H1047R)
DTRHGGWTTH

SEQ ID NO: 16032 - protein, 10 aa, Artificial Sequence
  Description of Artificial Sequence: Synthetic peptide
  Seed: DARHGGWTTK (PIK3CA H1047R)
DTRHGGWTTL

SEQ ID NO: 16033 - protein, 10 aa, Artificial Sequence
  Description of Artificial Sequence: Synthetic peptide
  Seed: DARHGGWTTK (PIK3CA H1047R)
DTRHGGWTTM

SEQ ID NO: 16034 - protein, 10 aa, Artificial Sequence
  Description of Artificial Sequence: Synthetic peptide
  Seed: DARHGGWTTK (PIK3CA H1047R)
DTRHGGWTTY

SEQ ID NO: 16035 - protein, 10 aa, Artificial Sequence
  Description of Artificial Sequence: Synthetic peptide
  Seed: DARHGGWTTK (PIK3CA H1047R)
DVRHGGWTTF

SEQ ID NO: 16036 - protein, 10 aa, Artificial Sequence
  Description of Artificial Sequence: Synthetic peptide
  Seed: DARHGGWTTK (PIK3CA H1047R)
DVRHGGWTTH

SEQ ID NO: 16037 - protein, 10 aa, Artificial Sequence
  Description of Artificial Sequence: Synthetic peptide
  Seed: DARHGGWTTK (PIK3CA H1047R)
DVRHGGWTTL

SEQ ID NO: 16038 - protein, 10 aa, Artificial Sequence
  Description of Artificial Sequence: Synthetic peptide
  Seed: DARHGGWTTK (PIK3CA H1047R)
DVRHGGWTTM

SEQ ID NO: 16039 - protein, 10 aa, Artificial Sequence
  Description of Artificial Sequence: Synthetic peptide
  Seed: DARHGGWTTK (PIK3CA H1047R)
DVRHGGWTTY

SEQ ID NO: 16040 - protein, 10 aa, Artificial Sequence
  Description of Artificial Sequence: Synthetic peptide
  Seed: DARHGGWTTK (PIK3CA H1047R)
DWRHGGWTTK

SEQ ID NO: 16041 - protein, 10 aa, Artificial Sequence
  Description of Artificial Sequence: Synthetic peptide
  Seed: DARHGGWTTK (PIK3CA H1047R)
DWRHGGWTTR

SEQ ID NO: 16042 - protein, 10 aa, Artificial Sequence
  Description of Artificial Sequence: Synthetic peptide
  Seed: DARHGGWTTK (PIK3CA H1047R)
DYRHGGWTTK

SEQ ID NO: 16043 - protein, 10 aa, Artificial Sequence
  Description of Artificial Sequence: Synthetic peptide
  Seed: DARHGGWTTK (PIK3CA H1047R)
DYRHGGWTTR

SEQ ID NO: 16044 - protein, 11 aa, Artificial Sequence
  Description of Artificial Sequence: Synthetic peptide
  Seed: KQMNDARHGGW (PIK3CA H1047R)
KAMNDARHGGF

SEQ ID NO: 16045 - protein, 11 aa, Artificial Sequence
  Description of Artificial Sequence: Synthetic peptide
  Seed: KQMNDARHGGW (PIK3CA H1047R)
KAMNDARHGGL

SEQ ID NO: 16046 - protein, 11 aa, Artificial Sequence
  Description of Artificial Sequence: Synthetic peptide
  Seed: KQMNDARHGGW (PIK3CA H1047R)
KAMNDARHGGM

SEQ ID NO: 16047 - protein, 11 aa, Artificial Sequence
  Description of Artificial Sequence: Synthetic peptide
  Seed: KQMNDARHGGW (PIK3CA H1047R)
KAMNDARHGGY

SEQ ID NO: 16048 - protein, 11 aa, Artificial Sequence
  Description of Artificial Sequence: Synthetic peptide
  Seed: KQMNDARHGGW (PIK3CA H1047R)
KCMNDARHGGF

SEQ ID NO: 16049 - protein, 11 aa, Artificial Sequence
  Description of Artificial Sequence: Synthetic peptide
  Seed: KQMNDARHGGW (PIK3CA H1047R)
KCMNDARHGGW

SEQ ID NO: 16050 - protein, 11 aa, Artificial Sequence
  Description of Artificial Sequence: Synthetic peptide
  Seed: KQMNDARHGGW (PIK3CA H1047R)
KCMNDARHGGY

SEQ ID NO: 16051 - protein, 11 aa, Artificial Sequence
  Description of Artificial Sequence: Synthetic peptide
  Seed: KQMNDARHGGW (PIK3CA H1047R)
KDMNDARHGGF

SEQ ID NO: 16052 - protein, 11 aa, Artificial Sequence
  Description of Artificial Sequence: Synthetic peptide
  Seed: KQMNDARHGGW (PIK3CA H1047R)
KDMNDARHGGW

SEQ ID NO: 16053 - protein, 11 aa, Artificial Sequence
  Description of Artificial Sequence: Synthetic peptide
  Seed: KQMNDARHGGW (PIK3CA H1047R)
KDMNDARHGGY

SEQ ID NO: 16054 - protein, 11 aa, Artificial Sequence
  Description of Artificial Sequence: Synthetic peptide
  Seed: KQMNDARHGGW (PIK3CA H1047R)
KEMNDARHGGC

SEQ ID NO: 16055 - protein, 11 aa, Artificial Sequence
  Description of Artificial Sequence: Synthetic peptide
  Seed: KQMNDARHGGW (PIK3CA H1047R)
KEMNDARHGGF

SEQ ID NO: 16056 - protein, 11 aa, Artificial Sequence
  Description of Artificial Sequence: Synthetic peptide
  Seed: KQMNDARHGGW (PIK3CA H1047R)
KEMNDARHGGH

SEQ ID NO: 16057 - protein, 11 aa, Artificial Sequence
  Description of Artificial Sequence: Synthetic peptide
  Seed: KQMNDARHGGW (PIK3CA H1047R)
KEMNDARHGGI

SEQ ID NO: 16058 - protein, 11 aa, Artificial Sequence
  Description of Artificial Sequence: Synthetic peptide
  Seed: KQMNDARHGGW (PIK3CA H1047R)
KEMNDARHGGL

SEQ ID NO: 16059 - protein, 11 aa, Artificial Sequence
  Description of Artificial Sequence: Synthetic peptide
  Seed: KQMNDARHGGW (PIK3CA H1047R)
KEMNDARHGGM

SEQ ID NO: 16060 - protein, 11 aa, Artificial Sequence
  Description of Artificial Sequence: Synthetic peptide
  Seed: KQMNDARHGGW (PIK3CA H1047R)
KEMNDARHGGV

SEQ ID NO: 16061 - protein, 11 aa, Artificial Sequence
  Description of Artificial Sequence: Synthetic peptide
  Seed: KQMNDARHGGW (PIK3CA H1047R)
KEMNDARHGGY

SEQ ID NO: 16062 - protein, 11 aa, Artificial Sequence
  Description of Artificial Sequence: Synthetic peptide
  Seed: KQMNDARHGGW (PIK3CA H1047R)
KFMNDARHGGF

SEQ ID NO: 16063 - protein, 11 aa, Artificial Sequence
  Description of Artificial Sequence: Synthetic peptide
  Seed: KQMNDARHGGW (PIK3CA H1047R)
KFMNDARHGGW

SEQ ID NO: 16064 - protein, 11 aa, Artificial Sequence
  Description of Artificial Sequence: Synthetic peptide
  Seed: KQMNDARHGGW (PIK3CA H1047R)
KFMNDARHGGY

SEQ ID NO: 16065 - protein, 11 aa, Artificial Sequence
  Description of Artificial Sequence: Synthetic peptide
  Seed: KQMNDARHGGW (PIK3CA H1047R)
KGMNDARHGGF

SEQ ID NO: 16066 - protein, 11 aa, Artificial Sequence
  Description of Artificial Sequence: Synthetic peptide
  Seed: KQMNDARHGGW (PIK3CA H1047R)
KGMNDARHGGW

SEQ ID NO: 16067 - protein, 11 aa, Artificial Sequence
  Description of Artificial Sequence: Synthetic peptide
  Seed: KQMNDARHGGW (PIK3CA H1047R)
KGMNDARHGGY

SEQ ID NO: 16068 - protein, 11 aa, Artificial Sequence
  Description of Artificial Sequence: Synthetic peptide
  Seed: KQMNDARHGGW (PIK3CA H1047R)
KHMNDARHGGY

SEQ ID NO: 16069 - protein, 11 aa, Artificial Sequence
  Description of Artificial Sequence: Synthetic peptide
  Seed: KQMNDARHGGW (PIK3CA H1047R)
KIMNDARHGGF

SEQ ID NO: 16070 - protein, 11 aa, Artificial Sequence
  Description of Artificial Sequence: Synthetic peptide
  Seed: KQMNDARHGGW (PIK3CA H1047R)
KIMNDARHGGI

SEQ ID NO: 16071 - protein, 11 aa, Artificial Sequence
  Description of Artificial Sequence: Synthetic peptide
  Seed: KQMNDARHGGW (PIK3CA H1047R)
KIMNDARHGGL

SEQ ID NO: 16072 - protein, 11 aa, Artificial Sequence
  Description of Artificial Sequence: Synthetic peptide
  Seed: KQMNDARHGGW (PIK3CA H1047R)
KIMNDARHGGM

SEQ ID NO: 16073 - protein, 11 aa, Artificial Sequence
  Description of Artificial Sequence: Synthetic peptide
  Seed: KQMNDARHGGW (PIK3CA H1047R)
KIMNDARHGGW

SEQ ID NO: 16074 - protein, 11 aa, Artificial Sequence
  Description of Artificial Sequence: Synthetic peptide
  Seed: KQMNDARHGGW (PIK3CA H1047R)
KIMNDARHGGY

SEQ ID NO: 16075 - protein, 11 aa, Artificial Sequence
  Description of Artificial Sequence: Synthetic peptide
  Seed: KQMNDARHGGW (PIK3CA H1047R)
KKMNDARHGGF

SEQ ID NO: 16076 - protein, 11 aa, Artificial Sequence
  Description of Artificial Sequence: Synthetic peptide
  Seed: KQMNDARHGGW (PIK3CA H1047R)
KKMNDARHGGW

SEQ ID NO: 16077 - protein, 11 aa, Artificial Sequence
  Description of Artificial Sequence: Synthetic peptide
  Seed: KQMNDARHGGW (PIK3CA H1047R)
KKMNDARHGGY

SEQ ID NO: 16078 - protein, 11 aa, Artificial Sequence
  Description of Artificial Sequence: Synthetic peptide
  Seed: KQMNDARHGGW (PIK3CA H1047R)
KLMNDARHGGF

SEQ ID NO: 16079 - protein, 11 aa, Artificial Sequence
  Description of Artificial Sequence: Synthetic peptide
  Seed: KQMNDARHGGW (PIK3CA H1047R)
KLMNDARHGGI

SEQ ID NO: 16080 - protein, 11 aa, Artificial Sequence
  Description of Artificial Sequence: Synthetic peptide
  Seed: KQMNDARHGGW (PIK3CA H1047R)
KLMNDARHGGL

SEQ ID NO: 16081 - protein, 11 aa, Artificial Sequence
  Description of Artificial Sequence: Synthetic peptide
  Seed: KQMNDARHGGW (PIK3CA H1047R)
KLMNDARHGGM

SEQ ID NO: 16082 - protein, 11 aa, Artificial Sequence
  Description of Artificial Sequence: Synthetic peptide
  Seed: KQMNDARHGGW (PIK3CA H1047R)
KLMNDARHGGV

SEQ ID NO: 16083 - protein, 11 aa, Artificial Sequence
  Description of Artificial Sequence: Synthetic peptide
  Seed: KQMNDARHGGW (PIK3CA H1047R)
KLMNDARHGGW

SEQ ID NO: 16084 - protein, 11 aa, Artificial Sequence
  Description of Artificial Sequence: Synthetic peptide
  Seed: KQMNDARHGGW (PIK3CA H1047R)
KLMNDARHGGY

SEQ ID NO: 16085 - protein, 11 aa, Artificial Sequence
  Description of Artificial Sequence: Synthetic peptide
  Seed: KQMNDARHGGW (PIK3CA H1047R)
KMMNDARHGGF

SEQ ID NO: 16086 - protein, 11 aa, Artificial Sequence
  Description of Artificial Sequence: Synthetic peptide
  Seed: KQMNDARHGGW (PIK3CA H1047R)
KMMNDARHGGI

SEQ ID NO: 16087 - protein, 11 aa, Artificial Sequence
  Description of Artificial Sequence: Synthetic peptide
  Seed: KQMNDARHGGW (PIK3CA H1047R)
KMMNDARHGGL

SEQ ID NO: 16088 - protein, 11 aa, Artificial Sequence
  Description of Artificial Sequence: Synthetic peptide
  Seed: KQMNDARHGGW (PIK3CA H1047R)
KMMNDARHGGM

SEQ ID NO: 16089 - protein, 11 aa, Artificial Sequence
  Description of Artificial Sequence: Synthetic peptide
  Seed: KQMNDARHGGW (PIK3CA H1047R)
KMMNDARHGGV

SEQ ID NO: 16090 - protein, 11 aa, Artificial Sequence
  Description of Artificial Sequence: Synthetic peptide
  Seed: KQMNDARHGGW (PIK3CA H1047R)
KMMNDARHGGW

SEQ ID NO: 16091 - protein, 11 aa, Artificial Sequence
  Description of Artificial Sequence: Synthetic peptide
  Seed: KQMNDARHGGW (PIK3CA H1047R)
KMMNDARHGGY

SEQ ID NO: 16092 - protein, 11 aa, Artificial Sequence
  Description of Artificial Sequence: Synthetic peptide
  Seed: KQMNDARHGGW (PIK3CA H1047R)
KNMNDARHGGW

SEQ ID NO: 16093 - protein, 11 aa, Artificial Sequence
  Description of Artificial Sequence: Synthetic peptide
  Seed: KQMNDARHGGW (PIK3CA H1047R)
KNMNDARHGGY

SEQ ID NO: 16094 - protein, 11 aa, Artificial Sequence
  Description of Artificial Sequence: Synthetic peptide
  Seed: KQMNDARHGGW (PIK3CA H1047R)
KPMNDARHGGW

SEQ ID NO: 16095 - protein, 11 aa, Artificial Sequence
  Description of Artificial Sequence: Synthetic peptide
  Seed: KQMNDARHGGW (PIK3CA H1047R)
KQMNDARHGGC

SEQ ID NO: 16096 - protein, 11 aa, Artificial Sequence
  Description of Artificial Sequence: Synthetic peptide
  Seed: KQMNDARHGGW (PIK3CA H1047R)
KQMNDARHGGI

SEQ ID NO: 16097 - protein, 11 aa, Artificial Sequence
  Description of Artificial Sequence: Synthetic peptide
  Seed: KQMNDARHGGW (PIK3CA H1047R)
KQMNDARHGGL

SEQ ID NO: 16098 - protein, 11 aa, Artificial Sequence
  Description of Artificial Sequence: Synthetic peptide
  Seed: KQMNDARHGGW (PIK3CA H1047R)
KQMNDARHGGM

SEQ ID NO: 16099 - protein, 11 aa, Artificial Sequence
  Description of Artificial Sequence: Synthetic peptide
  Seed: KQMNDARHGGW (PIK3CA H1047R)
KQMNDARHGGV

SEQ ID NO: 16100 - protein, 11 aa, Artificial Sequence
  Description of Artificial Sequence: Synthetic peptide
  Seed: KQMNDARHGGW (PIK3CA H1047R)
KRMNDARHGGA

SEQ ID NO: 16101 - protein, 11 aa, Artificial Sequence
  Description of Artificial Sequence: Synthetic peptide
  Seed: KQMNDARHGGW (PIK3CA H1047R)
KRMNDARHGGC

SEQ ID NO: 16102 - protein, 11 aa, Artificial Sequence
  Description of Artificial Sequence: Synthetic peptide
  Seed: KQMNDARHGGW (PIK3CA H1047R)
KRMNDARHGGF

SEQ ID NO: 16103 - protein, 11 aa, Artificial Sequence
  Description of Artificial Sequence: Synthetic peptide
  Seed: KQMNDARHGGW (PIK3CA H1047R)
KRMNDARHGGH

SEQ ID NO: 16104 - protein, 11 aa, Artificial Sequence
  Description of Artificial Sequence: Synthetic peptide
  Seed: KQMNDARHGGW (PIK3CA H1047R)
KRMNDARHGGI

SEQ ID NO: 16105 - protein, 11 aa, Artificial Sequence
  Description of Artificial Sequence: Synthetic peptide
  Seed: KQMNDARHGGW (PIK3CA H1047R)
KRMNDARHGGK

SEQ ID NO: 16106 - protein, 11 aa, Artificial Sequence
  Description of Artificial Sequence: Synthetic peptide
  Seed: KQMNDARHGGW (PIK3CA H1047R)
KRMNDARHGGL

SEQ ID NO: 16107 - protein, 11 aa, Artificial Sequence
  Description of Artificial Sequence: Synthetic peptide
  Seed: KQMNDARHGGW (PIK3CA H1047R)
KRMNDARHGGM

SEQ ID NO: 16108 - protein, 11 aa, Artificial Sequence
  Description of Artificial Sequence: Synthetic peptide
  Seed: KQMNDARHGGW (PIK3CA H1047R)
KRMNDARHGGQ

SEQ ID NO: 16109 - protein, 11 aa, Artificial Sequence
  Description of Artificial Sequence: Synthetic peptide
  Seed: KQMNDARHGGW (PIK3CA H1047R)
KRMNDARHGGR

SEQ ID NO: 16110 - protein, 11 aa, Artificial Sequence
  Description of Artificial Sequence: Synthetic peptide
  Seed: KQMNDARHGGW (PIK3CA H1047R)
KRMNDARHGGV

SEQ ID NO: 16111 - protein, 11 aa, Artificial Sequence
  Description of Artificial Sequence: Synthetic peptide
  Seed: KQMNDARHGGW (PIK3CA H1047R)
KRMNDARHGGW

SEQ ID NO: 16112 - protein, 11 aa, Artificial Sequence
  Description of Artificial Sequence: Synthetic peptide
  Seed: KQMNDARHGGW (PIK3CA H1047R)
KRMNDARHGGY

SEQ ID NO: 16113 - protein, 11 aa, Artificial Sequence
  Description of Artificial Sequence: Synthetic peptide
  Seed: KQMNDARHGGW (PIK3CA H1047R)
KSMNDARHGGF

SEQ ID NO: 16114 - protein, 11 aa, Artificial Sequence
  Description of Artificial Sequence: Synthetic peptide
  Seed: KQMNDARHGGW (PIK3CA H1047R)
KSMNDARHGGI

SEQ ID NO: 16115 - protein, 11 aa, Artificial Sequence
  Description of Artificial Sequence: Synthetic peptide
  Seed: KQMNDARHGGW (PIK3CA H1047R)
KSMNDARHGGL

SEQ ID NO: 16116 - protein, 11 aa, Artificial Sequence
  Description of Artificial Sequence: Synthetic peptide
  Seed: KQMNDARHGGW (PIK3CA H1047R)
KSMNDARHGGM

SEQ ID NO: 16117 - protein, 11 aa, Artificial Sequence
  Description of Artificial Sequence: Synthetic peptide
  Seed: KQMNDARHGGW (PIK3CA H1047R)
KSMNDARHGGW

SEQ ID NO: 16118 - protein, 11 aa, Artificial Sequence
  Description of Artificial Sequence: Synthetic peptide
  Seed: KQMNDARHGGW (PIK3CA H1047R)
KSMNDARHGGY

SEQ ID NO: 16119 - protein, 11 aa, Artificial Sequence
  Description of Artificial Sequence: Synthetic peptide
  Seed: KQMNDARHGGW (PIK3CA H1047R)
KTMNDARHGGF

SEQ ID NO: 16120 - protein, 11 aa, Artificial Sequence
  Description of Artificial Sequence: Synthetic peptide
  Seed: KQMNDARHGGW (PIK3CA H1047R)
KTMNDARHGGI

SEQ ID NO: 16121 - protein, 11 aa, Artificial Sequence
  Description of Artificial Sequence: Synthetic peptide
  Seed: KQMNDARHGGW (PIK3CA H1047R)
KTMNDARHGGL

SEQ ID NO: 16122 - protein, 11 aa, Artificial Sequence
  Description of Artificial Sequence: Synthetic peptide
  Seed: KQMNDARHGGW (PIK3CA H1047R)
KTMNDARHGGM

SEQ ID NO: 16123 - protein, 11 aa, Artificial Sequence
  Description of Artificial Sequence: Synthetic peptide
  Seed: KQMNDARHGGW (PIK3CA H1047R)
KTMNDARHGGY

SEQ ID NO: 16124 - protein, 11 aa, Artificial Sequence
  Description of Artificial Sequence: Synthetic peptide
  Seed: KQMNDARHGGW (PIK3CA H1047R)
KVMNDARHGGF

SEQ ID NO: 16125 - protein, 11 aa, Artificial Sequence
  Description of Artificial Sequence: Synthetic peptide
  Seed: KQMNDARHGGW (PIK3CA H1047R)
KVMNDARHGGI

SEQ ID NO: 16126 - protein, 11 aa, Artificial Sequence
  Description of Artificial Sequence: Synthetic peptide
  Seed: KQMNDARHGGW (PIK3CA H1047R)
KVMNDARHGGL

SEQ ID NO: 16127 - protein, 11 aa, Artificial Sequence
  Description of Artificial Sequence: Synthetic peptide
  Seed: KQMNDARHGGW (PIK3CA H1047R)
KVMNDARHGGW

SEQ ID NO: 16128 - protein, 11 aa, Artificial Sequence
  Description of Artificial Sequence: Synthetic peptide
  Seed: KQMNDARHGGW (PIK3CA H1047R)
KVMNDARHGGY

SEQ ID NO: 16129 - protein, 11 aa, Artificial Sequence
  Description of Artificial Sequence: Synthetic peptide
  Seed: KQMNDARHGGW (PIK3CA H1047R)
KWMNDARHGGF

SEQ ID NO: 16130 - protein, 11 aa, Artificial Sequence
  Description of Artificial Sequence: Synthetic peptide
  Seed: KQMNDARHGGW (PIK3CA H1047R)
KWMNDARHGGW

SEQ ID NO: 16131 - protein, 11 aa, Artificial Sequence
  Description of Artificial Sequence: Synthetic peptide
  Seed: KQMNDARHGGW (PIK3CA H1047R)
KWMNDARHGGY

SEQ ID NO: 16132 - protein, 11 aa, Artificial Sequence
  Description of Artificial Sequence: Synthetic peptide
  Seed: KQMNDARHGGW (PIK3CA H1047R)
KYMNDARHGGF

SEQ ID NO: 16133 - protein, 11 aa, Artificial Sequence
  Description of Artificial Sequence: Synthetic peptide
  Seed: KQMNDARHGGW (PIK3CA H1047R)
KYMNDARHGGW

SEQ ID NO: 16134 - protein, 11 aa, Artificial Sequence
  Description of Artificial Sequence: Synthetic peptide
  Seed: KQMNDARHGGW (PIK3CA H1047R)
KYMNDARHGGY

SEQ ID NO: 16135 - protein, 9 aa, Artificial Sequence
  Description of Artificial Sequence: Synthetic peptide
  Seed: MNDARHGGW (PIK3CA H1047R)
MADARHGGF

SEQ ID NO: 16136 - protein, 9 aa, Artificial Sequence
  Description of Artificial Sequence: Synthetic peptide
  Seed: MNDARHGGW (PIK3CA H1047R)
MADARHGGL

SEQ ID NO: 16137 - protein, 9 aa, Artificial Sequence
  Description of Artificial Sequence: Synthetic peptide
  Seed: MNDARHGGW (PIK3CA H1047R)
MADARHGGW

SEQ ID NO: 16138 - protein, 9 aa, Artificial Sequence
  Description of Artificial Sequence: Synthetic peptide
  Seed: MNDARHGGW (PIK3CA H1047R)
MADARHGGY

SEQ ID NO: 16139 - protein, 9 aa, Artificial Sequence
  Description of Artificial Sequence: Synthetic peptide
  Seed: MNDARHGGW (PIK3CA H1047R)
MCDARHGGF

SEQ ID NO: 16140 - protein, 9 aa, Artificial Sequence
  Description of Artificial Sequence: Synthetic peptide
  Seed: MNDARHGGW (PIK3CA H1047R)
MCDARHGGW

SEQ ID NO: 16141 - protein, 9 aa, Artificial Sequence
  Description of Artificial Sequence: Synthetic peptide
  Seed: MNDARHGGW (PIK3CA H1047R)
MDDARHGGW

SEQ ID NO: 16142 - protein, 9 aa, Artificial Sequence
  Description of Artificial Sequence: Synthetic peptide
  Seed: MNDARHGGW (PIK3CA H1047R)
MEDARHGGW

SEQ ID NO: 16143 - protein, 9 aa, Artificial Sequence
  Description of Artificial Sequence: Synthetic peptide
  Seed: MNDARHGGW (PIK3CA H1047R)
MFDARHGGF

SEQ ID NO: 16144 - protein, 9 aa, Artificial Sequence
  Description of Artificial Sequence: Synthetic peptide
  Seed: MNDARHGGW (PIK3CA H1047R)
MFDARHGGL

SEQ ID NO: 16145 - protein, 9 aa, Artificial Sequence
  Description of Artificial Sequence: Synthetic peptide
  Seed: MNDARHGGW (PIK3CA H1047R)
MFDARHGGM

SEQ ID NO: 16146 - protein, 9 aa, Artificial Sequence
  Description of Artificial Sequence: Synthetic peptide
  Seed: MNDARHGGW (PIK3CA H1047R)
MFDARHGGW

SEQ ID NO: 16147 - protein, 9 aa, Artificial Sequence
  Description of Artificial Sequence: Synthetic peptide
  Seed: MNDARHGGW (PIK3CA H1047R)
MFDARHGGY

SEQ ID NO: 16148 - protein, 9 aa, Artificial Sequence
  Description of Artificial Sequence: Synthetic peptide
  Seed: MNDARHGGW (PIK3CA H1047R)
MGDARHGGF

SEQ ID NO: 16149 - protein, 9 aa, Artificial Sequence
  Description of Artificial Sequence: Synthetic peptide
  Seed: MNDARHGGW (PIK3CA H1047R)
MGDARHGGW

SEQ ID NO: 16150 - protein, 9 aa, Artificial Sequence
  Description of Artificial Sequence: Synthetic peptide
  Seed: MNDARHGGW (PIK3CA H1047R)
MIDARHGGW

SEQ ID NO: 16151 - protein, 9 aa, Artificial Sequence
  Description of Artificial Sequence: Synthetic peptide
  Seed: MNDARHGGW (PIK3CA H1047R)
MLDARHGGW

SEQ ID NO: 16152 - protein, 9 aa, Artificial Sequence
  Description of Artificial Sequence: Synthetic peptide
  Seed: MNDARHGGW (PIK3CA H1047R)
MMDARHGGW

SEQ ID NO: 16153 - protein, 9 aa, Artificial Sequence
  Description of Artificial Sequence: Synthetic peptide
  Seed: MNDARHGGW (PIK3CA H1047R)
MPDARHGGW

SEQ ID NO: 16154 - protein, 9 aa, Artificial Sequence
  Description of Artificial Sequence: Synthetic peptide
  Seed: MNDARHGGW (PIK3CA H1047R)
MQDARHGGW

SEQ ID NO: 16155 - protein, 9 aa, Artificial Sequence
  Description of Artificial Sequence: Synthetic peptide
  Seed: MNDARHGGW (PIK3CA H1047R)
MSDARHGGF

SEQ ID NO: 16156 - protein, 9 aa, Artificial Sequence
  Description of Artificial Sequence: Synthetic peptide
  Seed: MNDARHGGW (PIK3CA H1047R)
MSDARHGGI

SEQ ID NO: 16157 - protein, 9 aa, Artificial Sequence
  Description of Artificial Sequence: Synthetic peptide
  Seed: MNDARHGGW (PIK3CA H1047R)
MSDARHGGL

SEQ ID NO: 16158 - protein, 9 aa, Artificial Sequence
  Description of Artificial Sequence: Synthetic peptide
  Seed: MNDARHGGW (PIK3CA H1047R)
MSDARHGGM

SEQ ID NO: 16159 - protein, 9 aa, Artificial Sequence
  Description of Artificial Sequence: Synthetic peptide
  Seed: MNDARHGGW (PIK3CA H1047R)
MSDARHGGW

SEQ ID NO: 16160 - protein, 9 aa, Artificial Sequence
  Description of Artificial Sequence: Synthetic peptide
  Seed: MNDARHGGW (PIK3CA H1047R)
MSDARHGGY

SEQ ID NO: 16161 - protein, 9 aa, Artificial Sequence
  Description of Artificial Sequence: Synthetic peptide
  Seed: MNDARHGGW (PIK3CA H1047R)
MTDARHGGF

SEQ ID NO: 16162 - protein, 9 aa, Artificial Sequence
  Description of Artificial Sequence: Synthetic peptide
  Seed: MNDARHGGW (PIK3CA H1047R)
MTDARHGGL

SEQ ID NO: 16163 - protein, 9 aa, Artificial Sequence
  Description of Artificial Sequence: Synthetic peptide
  Seed: MNDARHGGW (PIK3CA H1047R)
MTDARHGGW

SEQ ID NO: 16164 - protein, 9 aa, Artificial Sequence
  Description of Artificial Sequence: Synthetic peptide
  Seed: MNDARHGGW (PIK3CA H1047R)
MTDARHGGY

SEQ ID NO: 16165 - protein, 9 aa, Artificial Sequence
  Description of Artificial Sequence: Synthetic peptide
  Seed: MNDARHGGW (PIK3CA H1047R)
MVDARHGGF

SEQ ID NO: 16166 - protein, 9 aa, Artificial Sequence
  Description of Artificial Sequence: Synthetic peptide
  Seed: MNDARHGGW (PIK3CA H1047R)
MVDARHGGW

SEQ ID NO: 16167 - protein, 9 aa, Artificial Sequence
  Description of Artificial Sequence: Synthetic peptide
  Seed: MNDARHGGW (PIK3CA H1047R)
MWDARHGGF

SEQ ID NO: 16168 - protein, 9 aa, Artificial Sequence
  Description of Artificial Sequence: Synthetic peptide
  Seed: MNDARHGGW (PIK3CA H1047R)
MWDARHGGW

SEQ ID NO: 16169 - protein, 9 aa, Artificial Sequence
  Description of Artificial Sequence: Synthetic peptide
  Seed: MNDARHGGW (PIK3CA H1047R)
MYDARHGGF

SEQ ID NO: 16170 - protein, 9 aa, Artificial Sequence
  Description of Artificial Sequence: Synthetic peptide
  Seed: MNDARHGGW (PIK3CA H1047R)
MYDARHGGL

SEQ ID NO: 16171 - protein, 9 aa, Artificial Sequence
  Description of Artificial Sequence: Synthetic peptide
  Seed: MNDARHGGW (PIK3CA H1047R)
MYDARHGGW

SEQ ID NO: 16172 - protein, 10 aa, Artificial Sequence
  Description of Artificial Sequence: Synthetic peptide
  Seed: QMNDARHGGW (PIK3CA H1047R)
QANDARHGGW

SEQ ID NO: 16173 - protein, 10 aa, Artificial Sequence
  Description of Artificial Sequence: Synthetic peptide
  Seed: QMNDARHGGW (PIK3CA H1047R)
QCNDARHGGW

SEQ ID NO: 16174 - protein, 10 aa, Artificial Sequence
  Description of Artificial Sequence: Synthetic peptide
  Seed: QMNDARHGGW (PIK3CA H1047R)
QDNDARHGGW

SEQ ID NO: 16175 - protein, 10 aa, Artificial Sequence
  Description of Artificial Sequence: Synthetic peptide
  Seed: QMNDARHGGW (PIK3CA H1047R)
QENDARHGGW

SEQ ID NO: 16176 - protein, 10 aa, Artificial Sequence
  Description of Artificial Sequence: Synthetic peptide
  Seed: QMNDARHGGW (PIK3CA H1047R)
QFNDARHGGW

SEQ ID NO: 16177 - protein, 10 aa, Artificial Sequence
  Description of Artificial Sequence: Synthetic peptide
  Seed: QMNDARHGGW (PIK3CA H1047R)
QGNDARHGGW

SEQ ID NO: 16178 - protein, 10 aa, Artificial Sequence
  Description of Artificial Sequence: Synthetic peptide
  Seed: QMNDARHGGW (PIK3CA H1047R)
QINDARHGGF

SEQ ID NO: 16179 - protein, 10 aa, Artificial Sequence
  Description of Artificial Sequence: Synthetic peptide
  Seed: QMNDARHGGW (PIK3CA H1047R)
QINDARHGGW

SEQ ID NO: 16180 - protein, 10 aa, Artificial Sequence
  Description of Artificial Sequence: Synthetic peptide
  Seed: QMNDARHGGW (PIK3CA H1047R)
QLNDARHGGW

SEQ ID NO: 16181 - protein, 10 aa, Artificial Sequence
  Description of Artificial Sequence: Synthetic peptide
  Seed: QMNDARHGGW (PIK3CA H1047R)
QMNDARHGGF

SEQ ID NO: 16182 - protein, 10 aa, Artificial Sequence
  Description of Artificial Sequence: Synthetic peptide
  Seed: QMNDARHGGW (PIK3CA H1047R)
QNNDARHGGW

SEQ ID NO: 16183 - protein, 10 aa, Artificial Sequence
  Description of Artificial Sequence: Synthetic peptide
  Seed: QMNDARHGGW (PIK3CA H1047R)
QPNDARHGGW

SEQ ID NO: 16184 - protein, 10 aa, Artificial Sequence
  Description of Artificial Sequence: Synthetic peptide
  Seed: QMNDARHGGW (PIK3CA H1047R)
QQNDARHGGF

SEQ ID NO: 16185 - protein, 10 aa, Artificial Sequence
  Description of Artificial Sequence: Synthetic peptide
  Seed: QMNDARHGGW (PIK3CA H1047R)
QQNDARHGGI

SEQ ID NO: 16186 - protein, 10 aa, Artificial Sequence
  Description of Artificial Sequence: Synthetic peptide
  Seed: QMNDARHGGW (PIK3CA H1047R)
QQNDARHGGL

SEQ ID NO: 16187 - protein, 10 aa, Artificial Sequence
  Description of Artificial Sequence: Synthetic peptide
  Seed: QMNDARHGGW (PIK3CA H1047R)
QQNDARHGGW

SEQ ID NO: 16188 - protein, 10 aa, Artificial Sequence
  Description of Artificial Sequence: Synthetic peptide
  Seed: QMNDARHGGW (PIK3CA H1047R)
QSNDARHGGF

SEQ ID NO: 16189 - protein, 10 aa, Artificial Sequence
  Description of Artificial Sequence: Synthetic peptide
  Seed: QMNDARHGGW (PIK3CA H1047R)
QSNDARHGGW

SEQ ID NO: 16190 - protein, 10 aa, Artificial Sequence
  Description of Artificial Sequence: Synthetic peptide
  Seed: QMNDARHGGW (PIK3CA H1047R)
QTNDARHGGF

SEQ ID NO: 16191 - protein, 10 aa, Artificial Sequence
  Description of Artificial Sequence: Synthetic peptide
  Seed: QMNDARHGGW (PIK3CA H1047R)
QTNDARHGGW

SEQ ID NO: 16192 - protein, 10 aa, Artificial Sequence
  Description of Artificial Sequence: Synthetic peptide
  Seed: QMNDARHGGW (PIK3CA H1047R)
QTNDARHGGY

SEQ ID NO: 16193 - protein, 10 aa, Artificial Sequence
  Description of Artificial Sequence: Synthetic peptide
  Seed: QMNDARHGGW (PIK3CA H1047R)
QVNDARHGGF

SEQ ID NO: 16194 - protein, 10 aa, Artificial Sequence
  Description of Artificial Sequence: Synthetic peptide
  Seed: QMNDARHGGW (PIK3CA H1047R)
QVNDARHGGW

SEQ ID NO: 16195 - protein, 10 aa, Artificial Sequence
  Description of Artificial Sequence: Synthetic peptide
  Seed: QMNDARHGGW (PIK3CA H1047R)
QVNDARHGGY

SEQ ID NO: 16196 - protein, 10 aa, Artificial Sequence
  Description of Artificial Sequence: Synthetic peptide
  Seed: QMNDARHGGW (PIK3CA H1047R)
QWNDARHGGW

SEQ ID NO: 16197 - protein, 10 aa, Artificial Sequence
  Description of Artificial Sequence: Synthetic peptide
  Seed: QMNDARHGGW (PIK3CA H1047R)
QYNDARHGGW

SEQ ID NO: 16198 - protein, 9 aa, Artificial Sequence
  Description of Artificial Sequence: Synthetic peptide
  Seed: RHGGWTTKM (PIK3CA H1047R)
RAGGWTTKI

SEQ ID NO: 16199 - protein, 9 aa, Artificial Sequence
  Description of Artificial Sequence: Synthetic peptide
  Seed: RHGGWTTKM (PIK3CA H1047R)
RAGGWTTKL

SEQ ID NO: 16200 - protein, 9 aa, Artificial Sequence
  Description of Artificial Sequence: Synthetic peptide
  Seed: RHGGWTTKM (PIK3CA H1047R)
RAGGWTTKV

SEQ ID NO: 16201 - protein, 9 aa, Artificial Sequence
  Description of Artificial Sequence: Synthetic peptide
  Seed: RHGGWTTKM (PIK3CA H1047R)
RDGGWTTKL

SEQ ID NO: 16202 - protein, 9 aa, Artificial Sequence
  Description of Artificial Sequence: Synthetic peptide
  Seed: RHGGWTTKM (PIK3CA H1047R)
RDGGWTTKM

SEQ ID NO: 16203 - protein, 9 aa, Artificial Sequence
  Description of Artificial Sequence: Synthetic peptide
  Seed: RHGGWTTKM (PIK3CA H1047R)
REGGWTTKI

SEQ ID NO: 16204 - protein, 9 aa, Artificial Sequence
  Description of Artificial Sequence: Synthetic peptide
  Seed: RHGGWTTKM (PIK3CA H1047R)
REGGWTTKL

SEQ ID NO: 16205 - protein, 9 aa, Artificial Sequence
  Description of Artificial Sequence: Synthetic peptide
  Seed: RHGGWTTKM (PIK3CA H1047R)
REGGWTTKV

SEQ ID NO: 16206 - protein, 9 aa, Artificial Sequence
  Description of Artificial Sequence: Synthetic peptide
  Seed: RHGGWTTKM (PIK3CA H1047R)
RFGGWTTKF

SEQ ID NO: 16207 - protein, 9 aa, Artificial Sequence
  Description of Artificial Sequence: Synthetic peptide
  Seed: RHGGWTTKM (PIK3CA H1047R)
RFGGWTTKI

SEQ ID NO: 16208 - protein, 9 aa, Artificial Sequence
  Description of Artificial Sequence: Synthetic peptide
  Seed: RHGGWTTKM (PIK3CA H1047R)
RFGGWTTKL

SEQ ID NO: 16209 - protein, 9 aa, Artificial Sequence
  Description of Artificial Sequence: Synthetic peptide
  Seed: RHGGWTTKM (PIK3CA H1047R)
RFGGWTTKM

SEQ ID NO: 16210 - protein, 9 aa, Artificial Sequence
  Description of Artificial Sequence: Synthetic peptide
  Seed: RHGGWTTKM (PIK3CA H1047R)
RFGGWTTKY

SEQ ID NO: 16211 - protein, 9 aa, Artificial Sequence
  Description of Artificial Sequence: Synthetic peptide
  Seed: RHGGWTTKM (PIK3CA H1047R)
RGGGWTTKF

SEQ ID NO: 16212 - protein, 9 aa, Artificial Sequence
  Description of Artificial Sequence: Synthetic peptide
  Seed: RHGGWTTKM (PIK3CA H1047R)
RGGGWTTKI

SEQ ID NO: 16213 - protein, 9 aa, Artificial Sequence
  Description of Artificial Sequence: Synthetic peptide
  Seed: RHGGWTTKM (PIK3CA H1047R)
RGGGWTTKL

SEQ ID NO: 16214 - protein, 9 aa, Artificial Sequence
  Description of Artificial Sequence: Synthetic peptide
  Seed: RHGGWTTKM (PIK3CA H1047R)
RGGGWTTKM

SEQ ID NO: 16215 - protein, 9 aa, Artificial Sequence
  Description of Artificial Sequence: Synthetic peptide
  Seed: RHGGWTTKM (PIK3CA H1047R)
RGGGWTTKY

SEQ ID NO: 16216 - protein, 9 aa, Artificial Sequence
  Description of Artificial Sequence: Synthetic peptide
  Seed: RHGGWTTKM (PIK3CA H1047R)
RHGGWTTKC

SEQ ID NO: 16217 - protein, 9 aa, Artificial Sequence
  Description of Artificial Sequence: Synthetic peptide
  Seed: RHGGWTTKM (PIK3CA H1047R)
RHGGWTTKI

SEQ ID NO: 16218 - protein, 9 aa, Artificial Sequence
  Description of Artificial Sequence: Synthetic peptide
  Seed: RHGGWTTKM (PIK3CA H1047R)
RHGGWTTKL

SEQ ID NO: 16219 - protein, 9 aa, Artificial Sequence
  Description of Artificial Sequence: Synthetic peptide
  Seed: RHGGWTTKM (PIK3CA H1047R)
RHGGWTTKV

SEQ ID NO: 16220 - protein, 9 aa, Artificial Sequence
  Description of Artificial Sequence: Synthetic peptide
  Seed: RHGGWTTKM (PIK3CA H1047R)
RHGGWTTKW

SEQ ID NO: 16221 - protein, 9 aa, Artificial Sequence
  Description of Artificial Sequence: Synthetic peptide
  Seed: RHGGWTTKM (PIK3CA H1047R)
RIGGWTTKL

SEQ ID NO: 16222 - protein, 9 aa, Artificial Sequence
  Description of Artificial Sequence: Synthetic peptide
  Seed: RHGGWTTKM (PIK3CA H1047R)
RIGGWTTKM

SEQ ID NO: 16223 - protein, 9 aa, Artificial Sequence
  Description of Artificial Sequence: Synthetic peptide
  Seed: RHGGWTTKM (PIK3CA H1047R)
RIGGWTTKY

SEQ ID NO: 16224 - protein, 9 aa, Artificial Sequence
  Description of Artificial Sequence: Synthetic peptide
  Seed: RHGGWTTKM (PIK3CA H1047R)
RKGGWTTKI

SEQ ID NO: 16225 - protein, 9 aa, Artificial Sequence
  Description of Artificial Sequence: Synthetic peptide
  Seed: RHGGWTTKM (PIK3CA H1047R)
RKGGWTTKV

SEQ ID NO: 16226 - protein, 9 aa, Artificial Sequence
  Description of Artificial Sequence: Synthetic peptide
  Seed: RHGGWTTKM (PIK3CA H1047R)
RLGGWTTKL

SEQ ID NO: 16227 - protein, 9 aa, Artificial Sequence
  Description of Artificial Sequence: Synthetic peptide
  Seed: RHGGWTTKM (PIK3CA H1047R)
RLGGWTTKM

SEQ ID NO: 16228 - protein, 9 aa, Artificial Sequence
  Description of Artificial Sequence: Synthetic peptide
  Seed: RHGGWTTKM (PIK3CA H1047R)
RMGGWTTKI

SEQ ID NO: 16229 - protein, 9 aa, Artificial Sequence
  Description of Artificial Sequence: Synthetic peptide
  Seed: RHGGWTTKM (PIK3CA H1047R)
RNGGWTTKI

SEQ ID NO: 16230 - protein, 9 aa, Artificial Sequence
  Description of Artificial Sequence: Synthetic peptide
  Seed: RHGGWTTKM (PIK3CA H1047R)
RNGGWTTKL

SEQ ID NO: 16231 - protein, 9 aa, Artificial Sequence
  Description of Artificial Sequence: Synthetic peptide
  Seed: RHGGWTTKM (PIK3CA H1047R)
RNGGWTTKM

SEQ ID NO: 16232 - protein, 9 aa, Artificial Sequence
  Description of Artificial Sequence: Synthetic peptide
  Seed: RHGGWTTKM (PIK3CA H1047R)
RNGGWTTKY

SEQ ID NO: 16233 - protein, 9 aa, Artificial Sequence
  Description of Artificial Sequence: Synthetic peptide
  Seed: RHGGWTTKM (PIK3CA H1047R)
RPGGWTTKF

SEQ ID NO: 16234 - protein, 9 aa, Artificial Sequence
  Description of Artificial Sequence: Synthetic peptide
  Seed: RHGGWTTKM (PIK3CA H1047R)
RPGGWTTKL

SEQ ID NO: 16235 - protein, 9 aa, Artificial Sequence
  Description of Artificial Sequence: Synthetic peptide
  Seed: RHGGWTTKM (PIK3CA H1047R)
RPGGWTTKY

SEQ ID NO: 16236 - protein, 9 aa, Artificial Sequence
  Description of Artificial Sequence: Synthetic peptide
  Seed: RHGGWTTKM (PIK3CA H1047R)
RQGGWTTKV

SEQ ID NO: 16237 - protein, 9 aa, Artificial Sequence
  Description of Artificial Sequence: Synthetic peptide
  Seed: RHGGWTTKM (PIK3CA H1047R)
RRGGWTTKA

SEQ ID NO: 16238 - protein, 9 aa, Artificial Sequence
  Description of Artificial Sequence: Synthetic peptide
  Seed: RHGGWTTKM (PIK3CA H1047R)
RRGGWTTKC

SEQ ID NO: 16239 - protein, 9 aa, Artificial Sequence
  Description of Artificial Sequence: Synthetic peptide
  Seed: RHGGWTTKM (PIK3CA H1047R)
RRGGWTTKG

SEQ ID NO: 16240 - protein, 9 aa, Artificial Sequence
  Description of Artificial Sequence: Synthetic peptide
  Seed: RHGGWTTKM (PIK3CA H1047R)
RRGGWTTKH

SEQ ID NO: 16241 - protein, 9 aa, Artificial Sequence
  Description of Artificial Sequence: Synthetic peptide
  Seed: RHGGWTTKM (PIK3CA H1047R)
RRGGWTTKI

SEQ ID NO: 16242 - protein, 9 aa, Artificial Sequence
  Description of Artificial Sequence: Synthetic peptide
  Seed: RHGGWTTKM (PIK3CA H1047R)
RRGGWTTKK

SEQ ID NO: 16243 - protein, 9 aa, Artificial Sequence
  Description of Artificial Sequence: Synthetic peptide
  Seed: RHGGWTTKM (PIK3CA H1047R)
RRGGWTTKM

SEQ ID NO: 16244 - protein, 9 aa, Artificial Sequence
  Description of Artificial Sequence: Synthetic peptide
  Seed: RHGGWTTKM (PIK3CA H1047R)
RRGGWTTKP

SEQ ID NO: 16245 - protein, 9 aa, Artificial Sequence
  Description of Artificial Sequence: Synthetic peptide
  Seed: RHGGWTTKM (PIK3CA H1047R)
RRGGWTTKQ

SEQ ID NO: 16246 - protein, 9 aa, Artificial Sequence
  Description of Artificial Sequence: Synthetic peptide
  Seed: RHGGWTTKM (PIK3CA H1047R)
RRGGWTTKR

SEQ ID NO: 16247 - protein, 9 aa, Artificial Sequence
  Description of Artificial Sequence: Synthetic peptide
  Seed: RHGGWTTKM (PIK3CA H1047R)
RRGGWTTKS

SEQ ID NO: 16248 - protein, 9 aa, Artificial Sequence
  Description of Artificial Sequence: Synthetic peptide
  Seed: RHGGWTTKM (PIK3CA H1047R)
RRGGWTTKT

SEQ ID NO: 16249 - protein, 9 aa, Artificial Sequence
  Description of Artificial Sequence: Synthetic peptide
  Seed: RHGGWTTKM (PIK3CA H1047R)
RRGGWTTKV

SEQ ID NO: 16250 - protein, 9 aa, Artificial Sequence
  Description of Artificial Sequence: Synthetic peptide
  Seed: RHGGWTTKM (PIK3CA H1047R)
RRGGWTTKW

SEQ ID NO: 16251 - protein, 9 aa, Artificial Sequence
  Description of Artificial Sequence: Synthetic peptide
  Seed: RHGGWTTKM (PIK3CA H1047R)
RSGGWTTKI

SEQ ID NO: 16252 - protein, 9 aa, Artificial Sequence
  Description of Artificial Sequence: Synthetic peptide
  Seed: RHGGWTTKM (PIK3CA H1047R)
RSGGWTTKL

SEQ ID NO: 16253 - protein, 9 aa, Artificial Sequence
  Description of Artificial Sequence: Synthetic peptide
  Seed: RHGGWTTKM (PIK3CA H1047R)
RSGGWTTKM

SEQ ID NO: 16254 - protein, 9 aa, Artificial Sequence
  Description of Artificial Sequence: Synthetic peptide
  Seed: RHGGWTTKM (PIK3CA H1047R)
RSGGWTTKV

SEQ ID NO: 16255 - protein, 9 aa, Artificial Sequence
  Description of Artificial Sequence: Synthetic peptide
  Seed: RHGGWTTKM (PIK3CA H1047R)
RTGGWTTKL

SEQ ID NO: 16256 - protein, 9 aa, Artificial Sequence
  Description of Artificial Sequence: Synthetic peptide
  Seed: RHGGWTTKM (PIK3CA H1047R)
RTGGWTTKM

SEQ ID NO: 16257 - protein, 9 aa, Artificial Sequence
  Description of Artificial Sequence: Synthetic peptide
  Seed: RHGGWTTKM (PIK3CA H1047R)
RTGGWTTKY

SEQ ID NO: 16258 - protein, 9 aa, Artificial Sequence
  Description of Artificial Sequence: Synthetic peptide
  Seed: RHGGWTTKM (PIK3CA H1047R)
RVGGWTTKI

SEQ ID NO: 16259 - protein, 9 aa, Artificial Sequence
  Description of Artificial Sequence: Synthetic peptide
  Seed: RHGGWTTKM (PIK3CA H1047R)
RVGGWTTKL

SEQ ID NO: 16260 - protein, 9 aa, Artificial Sequence
  Description of Artificial Sequence: Synthetic peptide
  Seed: RHGGWTTKM (PIK3CA H1047R)
RVGGWTTKM

SEQ ID NO: 16261 - protein, 9 aa, Artificial Sequence
  Description of Artificial Sequence: Synthetic peptide
  Seed: RHGGWTTKM (PIK3CA H1047R)
RWGGWTTKF

SEQ ID NO: 16262 - protein, 9 aa, Artificial Sequence
  Description of Artificial Sequence: Synthetic peptide
  Seed: RHGGWTTKM (PIK3CA H1047R)
RWGGWTTKL

SEQ ID NO: 16263 - protein, 9 aa, Artificial Sequence
  Description of Artificial Sequence: Synthetic peptide
  Seed: RHGGWTTKM (PIK3CA H1047R)
RWGGWTTKM

SEQ ID NO: 16264 - protein, 9 aa, Artificial Sequence
  Description of Artificial Sequence: Synthetic peptide
  Seed: RHGGWTTKM (PIK3CA H1047R)
RWGGWTTKY

SEQ ID NO: 16265 - protein, 9 aa, Artificial Sequence
  Description of Artificial Sequence: Synthetic peptide
  Seed: RHGGWTTKM (PIK3CA H1047R)
RYGGWTTKF

SEQ ID NO: 16266 - protein, 9 aa, Artificial Sequence
  Description of Artificial Sequence: Synthetic peptide
  Seed: RHGGWTTKM (PIK3CA H1047R)
RYGGWTTKI

SEQ ID NO: 16267 - protein, 9 aa, Artificial Sequence
  Description of Artificial Sequence: Synthetic peptide
  Seed: RHGGWTTKM (PIK3CA H1047R)
RYGGWTTKL

SEQ ID NO: 16268 - protein, 9 aa, Artificial Sequence
  Description of Artificial Sequence: Synthetic peptide
  Seed: RHGGWTTKM (PIK3CA H1047R)
RYGGWTTKM

SEQ ID NO: 16269 - protein, 9 aa, Artificial Sequence
  Description of Artificial Sequence: Synthetic peptide
  Seed: RHGGWTTKM (PIK3CA H1047R)
RYGGWTTKV

SEQ ID NO: 16270 - protein, 9 aa, Artificial Sequence
  Description of Artificial Sequence: Synthetic peptide
  Seed: RHGGWTTKM (PIK3CA H1047R)
RYGGWTTKY

SEQ ID NO: 16271 - protein, 10 aa, Homo sapiens
  Native (PIK3CA H1047R)
DARHGGWTTK

SEQ ID NO: 16272 - protein, 9 aa, Homo sapiens
  Native (PIK3CA H1047R)
KQMNDARHG

SEQ ID NO: 16273 - protein, 9 aa, Homo sapiens
  Native (PIK3CA H1047R)
RHGGWTTKM

SEQ ID NO: 16274 - protein, 11 aa, Homo sapiens
  Native (PIK3CA H1047R)
KQMNDARHGGW

SEQ ID NO: 16275 - protein, 9 aa, Homo sapiens
  Native (PIK3CA H1047R)
MNDARHGGW

SEQ ID NO: 16276 - protein, 10 aa, Homo sapiens
  Native (PIK3CA H1047R)
QMNDARHGGW

SEQ ID NO: 16277 - protein, 10 aa, Artificial Sequence
  Description of Artificial Sequence: Synthetic peptide
  Seed: DETRQLCDLR (PIK3CA R88Q)
DATRQLCDLK

SEQ ID NO: 16278 - protein, 10 aa, Artificial Sequence
  Description of Artificial Sequence: Synthetic peptide
  Seed: DETRQLCDLR (PIK3CA R88Q)
DATRQLCDLR

SEQ ID NO: 16279 - protein, 10 aa, Artificial Sequence
  Description of Artificial Sequence: Synthetic peptide
  Seed: DETRQLCDLR (PIK3CA R88Q)
DCTRQLCDLR

SEQ ID NO: 16280 - protein, 10 aa, Artificial Sequence
  Description of Artificial Sequence: Synthetic peptide
  Seed: DETRQLCDLR (PIK3CA R88Q)
DDTRQLCDLR

SEQ ID NO: 16281 - protein, 10 aa, Artificial Sequence
  Description of Artificial Sequence: Synthetic peptide
  Seed: DETRQLCDLR (PIK3CA R88Q)
DGTRQLCDLR

SEQ ID NO: 16282 - protein, 10 aa, Artificial Sequence
  Description of Artificial Sequence: Synthetic peptide
  Seed: DETRQLCDLR (PIK3CA R88Q)
DHTRQLCDLR

SEQ ID NO: 16283 - protein, 10 aa, Artificial Sequence
  Description of Artificial Sequence: Synthetic peptide
  Seed: DETRQLCDLR (PIK3CA R88Q)
DITRQLCDLK

SEQ ID NO: 16284 - protein, 10 aa, Artificial Sequence
  Description of Artificial Sequence: Synthetic peptide
  Seed: DETRQLCDLR (PIK3CA R88Q)
DITRQLCDLR

SEQ ID NO: 16285 - protein, 10 aa, Artificial Sequence
  Description of Artificial Sequence: Synthetic peptide
  Seed: DETRQLCDLR (PIK3CA R88Q)
DKTRQLCDLR

SEQ ID NO: 16286 - protein, 10 aa, Artificial Sequence
  Description of Artificial Sequence: Synthetic peptide
  Seed: DETRQLCDLR (PIK3CA R88Q)
DLTRQLCDLR

SEQ ID NO: 16287 - protein, 10 aa, Artificial Sequence
  Description of Artificial Sequence: Synthetic peptide
  Seed: DETRQLCDLR (PIK3CA R88Q)
DMTRQLCDLK

SEQ ID NO: 16288 - protein, 10 aa, Artificial Sequence
  Description of Artificial Sequence: Synthetic peptide
  Seed: DETRQLCDLR (PIK3CA R88Q)
DMTRQLCDLR

SEQ ID NO: 16289 - protein, 10 aa, Artificial Sequence
  Description of Artificial Sequence: Synthetic peptide
  Seed: DETRQLCDLR (PIK3CA R88Q)
DNTRQLCDLR

SEQ ID NO: 16290 - protein, 10 aa, Artificial Sequence
  Description of Artificial Sequence: Synthetic peptide
  Seed: DETRQLCDLR (PIK3CA R88Q)
DPTRQLCDLR

SEQ ID NO: 16291 - protein, 10 aa, Artificial Sequence
  Description of Artificial Sequence: Synthetic peptide
  Seed: DETRQLCDLR (PIK3CA R88Q)
DQTRQLCDLR

SEQ ID NO: 16292 - protein, 10 aa, Artificial Sequence
  Description of Artificial Sequence: Synthetic peptide
  Seed: DETRQLCDLR (PIK3CA R88Q)
DRTRQLCDLR

SEQ ID NO: 16293 - protein, 10 aa, Artificial Sequence
  Description of Artificial Sequence: Synthetic peptide
  Seed: DETRQLCDLR (PIK3CA R88Q)
DSTRQLCDLK

SEQ ID NO: 16294 - protein, 10 aa, Artificial Sequence
  Description of Artificial Sequence: Synthetic peptide
  Seed: DETRQLCDLR (PIK3CA R88Q)
DSTRQLCDLR

SEQ ID NO: 16295 - protein, 10 aa, Artificial Sequence
  Description of Artificial Sequence: Synthetic peptide
  Seed: DETRQLCDLR (PIK3CA R88Q)
DTTRQLCDLK

SEQ ID NO: 16296 - protein, 10 aa, Artificial Sequence
  Description of Artificial Sequence: Synthetic peptide
  Seed: DETRQLCDLR (PIK3CA R88Q)
DTTRQLCDLR

SEQ ID NO: 16297 - protein, 10 aa, Artificial Sequence
  Description of Artificial Sequence: Synthetic peptide
  Seed: DETRQLCDLR (PIK3CA R88Q)
DVTRQLCDLK

SEQ ID NO: 16298 - protein, 10 aa, Artificial Sequence
  Description of Artificial Sequence: Synthetic peptide
  Seed: DETRQLCDLR (PIK3CA R88Q)
DVTRQLCDLR

SEQ ID NO: 16299 - protein, 10 aa, Artificial Sequence
  Description of Artificial Sequence: Synthetic peptide
  Seed: DETRQLCDLR (PIK3CA R88Q)
DWTRQLCDLR

SEQ ID NO: 16300 - protein, 10 aa, Artificial Sequence
  Description of Artificial Sequence: Synthetic peptide
  Seed: DETRQLCDLR (PIK3CA R88Q)
DYTRQLCDLR

SEQ ID NO: 16301 - protein, 9 aa, Artificial Sequence
  Description of Artificial Sequence: Synthetic peptide
  Seed: ETRQLCDLR (PIK3CA R88Q)
EARQLCDLK

SEQ ID NO: 16302 - protein, 9 aa, Artificial Sequence
  Description of Artificial Sequence: Synthetic peptide
  Seed: ETRQLCDLR (PIK3CA R88Q)
EARQLCDLR

SEQ ID NO: 16303 - protein, 9 aa, Artificial Sequence
  Description of Artificial Sequence: Synthetic peptide
  Seed: EFFDETRQL (PIK3CA R88Q)
EFFDETRQF

SEQ ID NO: 16304 - protein, 9 aa, Artificial Sequence
  Description of Artificial Sequence: Synthetic peptide
  Seed: EFFDETRQL (PIK3CA R88Q)
EFFDETRQM

SEQ ID NO: 16305 - protein, 9 aa, Artificial Sequence
  Description of Artificial Sequence: Synthetic peptide
  Seed: EFFDETRQL (PIK3CA R88Q)
EFFDETRQY

SEQ ID NO: 16306 - protein, 9 aa, Artificial Sequence
  Description of Artificial Sequence: Synthetic peptide
  Seed: ETRQLCDLR (PIK3CA R88Q)
EFRQLCDLR

SEQ ID NO: 16307 - protein, 9 aa, Artificial Sequence
  Description of Artificial Sequence: Synthetic peptide
  Seed: ETRQLCDLR (PIK3CA R88Q)
EGRQLCDLR

SEQ ID NO: 16308 - protein, 9 aa, Artificial Sequence
  Description of Artificial Sequence: Synthetic peptide
  Seed: ETRQLCDLR (PIK3CA R88Q)
EIRQLCDLK

SEQ ID NO: 16309 - protein, 9 aa, Artificial Sequence
  Description of Artificial Sequence: Synthetic peptide
  Seed: ETRQLCDLR (PIK3CA R88Q)
ELRQLCDLK

SEQ ID NO: 16310 - protein, 9 aa, Artificial Sequence
  Description of Artificial Sequence: Synthetic peptide
  Seed: ETRQLCDLR (PIK3CA R88Q)
ELRQLCDLR

SEQ ID NO: 16311 - protein, 9 aa, Artificial Sequence
  Description of Artificial Sequence: Synthetic peptide
  Seed: ETRQLCDLR (PIK3CA R88Q)
EMRQLCDLK

SEQ ID NO: 16312 - protein, 9 aa, Artificial Sequence
  Description of Artificial Sequence: Synthetic peptide
  Seed: ETRQLCDLR (PIK3CA R88Q)
ENRQLCDLR

SEQ ID NO: 16313 - protein, 9 aa, Artificial Sequence
  Description of Artificial Sequence: Synthetic peptide
  Seed: ETRQLCDLR (PIK3CA R88Q)
ESRQLCDLK

SEQ ID NO: 16314 - protein, 9 aa, Artificial Sequence
  Description of Artificial Sequence: Synthetic peptide
  Seed: ETRQLCDLR (PIK3CA R88Q)
ETRQLCDLK

SEQ ID NO: 16315 - protein, 9 aa, Artificial Sequence
  Description of Artificial Sequence: Synthetic peptide
  Seed: ETRQLCDLR (PIK3CA R88Q)
EVRQLCDLK

SEQ ID NO: 16316 - protein, 9 aa, Artificial Sequence
  Description of Artificial Sequence: Synthetic peptide
  Seed: EFFDETRQL (PIK3CA R88Q)
EWFDETRQF

SEQ ID NO: 16317 - protein, 9 aa, Artificial Sequence
  Description of Artificial Sequence: Synthetic peptide
  Seed: EFFDETRQL (PIK3CA R88Q)
EWFDETRQL

SEQ ID NO: 16318 - protein, 9 aa, Artificial Sequence
  Description of Artificial Sequence: Synthetic peptide
  Seed: EFFDETRQL (PIK3CA R88Q)
EWFDETRQM

SEQ ID NO: 16319 - protein, 9 aa, Artificial Sequence
  Description of Artificial Sequence: Synthetic peptide
  Seed: ETRQLCDLR (PIK3CA R88Q)
EWRQLCDLR

SEQ ID NO: 16320 - protein, 9 aa, Artificial Sequence
  Description of Artificial Sequence: Synthetic peptide
  Seed: EFFDETRQL (PIK3CA R88Q)
EYFDETRQF

SEQ ID NO: 16321 - protein, 9 aa, Artificial Sequence
  Description of Artificial Sequence: Synthetic peptide
  Seed: EFFDETRQL (PIK3CA R88Q)
EYFDETRQI

SEQ ID NO: 16322 - protein, 9 aa, Artificial Sequence
  Description of Artificial Sequence: Synthetic peptide
  Seed: EFFDETRQL (PIK3CA R88Q)
EYFDETRQL

SEQ ID NO: 16323 - protein, 9 aa, Artificial Sequence
  Description of Artificial Sequence: Synthetic peptide
  Seed: EFFDETRQL (PIK3CA R88Q)
EYFDETRQV

SEQ ID NO: 16324 - protein, 9 aa, Artificial Sequence
  Description of Artificial Sequence: Synthetic peptide
  Seed: EFFDETRQL (PIK3CA R88Q)
EYFDETRQY

SEQ ID NO: 16325 - protein, 9 aa, Artificial Sequence
  Description of Artificial Sequence: Synthetic peptide
  Seed: ETRQLCDLR (PIK3CA R88Q)
EYRQLCDLR

SEQ ID NO: 16326 - protein, 8 aa, Artificial Sequence
  Description of Artificial Sequence: Synthetic peptide
  Seed: FFDETRQL (PIK3CA R88Q)
FFDETRQF

SEQ ID NO: 16327 - protein, 8 aa, Artificial Sequence
  Description of Artificial Sequence: Synthetic peptide
  Seed: FFDETRQL (PIK3CA R88Q)
FFDETRQM

SEQ ID NO: 16328 - protein, 8 aa, Artificial Sequence
  Description of Artificial Sequence: Synthetic peptide
  Seed: FFDETRQL (PIK3CA R88Q)
FFDETRQY

SEQ ID NO: 16329 - protein, 8 aa, Artificial Sequence
  Description of Artificial Sequence: Synthetic peptide
  Seed: FFDETRQL (PIK3CA R88Q)
FMDETRQM

SEQ ID NO: 16330 - protein, 8 aa, Artificial Sequence
  Description of Artificial Sequence: Synthetic peptide
  Seed: FFDETRQL (PIK3CA R88Q)
FWDETRQF

SEQ ID NO: 16331 - protein, 8 aa, Artificial Sequence
  Description of Artificial Sequence: Synthetic peptide
  Seed: FFDETRQL (PIK3CA R88Q)
FWDETRQL

SEQ ID NO: 16332 - protein, 8 aa, Artificial Sequence
  Description of Artificial Sequence: Synthetic peptide
  Seed: FFDETRQL (PIK3CA R88Q)
FWDETRQM

SEQ ID NO: 16333 - protein, 8 aa, Artificial Sequence
  Description of Artificial Sequence: Synthetic peptide
  Seed: FFDETRQL (PIK3CA R88Q)
FWDETRQY

SEQ ID NO: 16334 - protein, 8 aa, Artificial Sequence
  Description of Artificial Sequence: Synthetic peptide
  Seed: FFDETRQL (PIK3CA R88Q)
FYDETRQF

SEQ ID NO: 16335 - protein, 8 aa, Artificial Sequence
  Description of Artificial Sequence: Synthetic peptide
  Seed: FFDETRQL (PIK3CA R88Q)
FYDETRQI

SEQ ID NO: 16336 - protein, 8 aa, Artificial Sequence
  Description of Artificial Sequence: Synthetic peptide
  Seed: FFDETRQL (PIK3CA R88Q)
FYDETRQV

SEQ ID NO: 16337 - protein, 8 aa, Artificial Sequence
  Description of Artificial Sequence: Synthetic peptide
  Seed: FFDETRQL (PIK3CA R88Q)
FYDETRQY

SEQ ID NO: 16338 - protein, 11 aa, Artificial Sequence
  Description of Artificial Sequence: Synthetic peptide
  Seed: QLCDLRLFQPF (PIK3CA R88Q)
QLCDLRLFQPY

SEQ ID NO: 16339 - protein, 11 aa, Artificial Sequence
  Description of Artificial Sequence: Synthetic peptide
  Seed: QLCDLRLFQPF (PIK3CA R88Q)
QMCDLRLFQPF

SEQ ID NO: 16340 - protein, 11 aa, Artificial Sequence
  Description of Artificial Sequence: Synthetic peptide
  Seed: QLCDLRLFQPF (PIK3CA R88Q)
QMCDLRLFQPM

SEQ ID NO: 16341 - protein, 11 aa, Artificial Sequence
  Description of Artificial Sequence: Synthetic peptide
  Seed: QLCDLRLFQPF (PIK3CA R88Q)
QMCDLRLFQPY

SEQ ID NO: 16342 - protein, 11 aa, Artificial Sequence
  Description of Artificial Sequence: Synthetic peptide
  Seed: QLCDLRLFQPF (PIK3CA R88Q)
QQCDLRLFQPF

SEQ ID NO: 16343 - protein, 11 aa, Artificial Sequence
  Description of Artificial Sequence: Synthetic peptide
  Seed: QLCDLRLFQPF (PIK3CA R88Q)
QQCDLRLFQPM

SEQ ID NO: 16344 - protein, 11 aa, Artificial Sequence
  Description of Artificial Sequence: Synthetic peptide
  Seed: QLCDLRLFQPF (PIK3CA R88Q)
QQCDLRLFQPY

SEQ ID NO: 16345 - protein, 11 aa, Artificial Sequence
  Description of Artificial Sequence: Synthetic peptide
  Seed: REEFFDETRQL (PIK3CA R88Q)
REEFFDETRQI

SEQ ID NO: 16346 - protein, 11 aa, Artificial Sequence
  Description of Artificial Sequence: Synthetic peptide
  Seed: REEFFDETRQL (PIK3CA R88Q)
REEFFDETRQM

SEQ ID NO: 16347 - protein, 11 aa, Artificial Sequence
  Description of Artificial Sequence: Synthetic peptide
  Seed: REEFFDETRQL (PIK3CA R88Q)
REEFFDETRQV

SEQ ID NO: 16348 - protein, 10 aa, Artificial Sequence
  Description of Artificial Sequence: Synthetic peptide
  Seed: TRQLCDLRLF (PIK3CA R88Q)
TAQLCDLRLF

SEQ ID NO: 16349 - protein, 10 aa, Artificial Sequence
  Description of Artificial Sequence: Synthetic peptide
  Seed: TRQLCDLRLF (PIK3CA R88Q)
TAQLCDLRLY

SEQ ID NO: 16350 - protein, 10 aa, Artificial Sequence
  Description of Artificial Sequence: Synthetic peptide
  Seed: TRQLCDLRLF (PIK3CA R88Q)
TCQLCDLRLF

SEQ ID NO: 16351 - protein, 10 aa, Artificial Sequence
  Description of Artificial Sequence: Synthetic peptide
  Seed: TRQLCDLRLF (PIK3CA R88Q)
TCQLCDLRLY

SEQ ID NO: 16352 - protein, 10 aa, Artificial Sequence
  Description of Artificial Sequence: Synthetic peptide
  Seed: TRQLCDLRLF (PIK3CA R88Q)
TDQLCDLRLF

SEQ ID NO: 16353 - protein, 10 aa, Artificial Sequence
  Description of Artificial Sequence: Synthetic peptide
  Seed: TRQLCDLRLF (PIK3CA R88Q)
TDQLCDLRLY

SEQ ID NO: 16354 - protein, 10 aa, Artificial Sequence
  Description of Artificial Sequence: Synthetic peptide
  Seed: TRQLCDLRLF (PIK3CA R88Q)
TEQLCDLRLF

SEQ ID NO: 16355 - protein, 10 aa, Artificial Sequence
  Description of Artificial Sequence: Synthetic peptide
  Seed: TRQLCDLRLF (PIK3CA R88Q)
TEQLCDLRLY

SEQ ID NO: 16356 - protein, 10 aa, Artificial Sequence
  Description of Artificial Sequence: Synthetic peptide
  Seed: TRQLCDLRLF (PIK3CA R88Q)
TFQLCDLRLF

SEQ ID NO: 16357 - protein, 10 aa, Artificial Sequence
  Description of Artificial Sequence: Synthetic peptide
  Seed: TRQLCDLRLF (PIK3CA R88Q)
TFQLCDLRLY

SEQ ID NO: 16358 - protein, 10 aa, Artificial Sequence
  Description of Artificial Sequence: Synthetic peptide
  Seed: TRQLCDLRLF (PIK3CA R88Q)
TGQLCDLRLF

SEQ ID NO: 16359 - protein, 10 aa, Artificial Sequence
  Description of Artificial Sequence: Synthetic peptide
  Seed: TRQLCDLRLF (PIK3CA R88Q)
TGQLCDLRLY

SEQ ID NO: 16360 - protein, 10 aa, Artificial Sequence
  Description of Artificial Sequence: Synthetic peptide
  Seed: TRQLCDLRLF (PIK3CA R88Q)
THQLCDLRLF

SEQ ID NO: 16361 - protein, 10 aa, Artificial Sequence
  Description of Artificial Sequence: Synthetic peptide
  Seed: TRQLCDLRLF (PIK3CA R88Q)
THQLCDLRLY

SEQ ID NO: 16362 - protein, 10 aa, Artificial Sequence
  Description of Artificial Sequence: Synthetic peptide
  Seed: TRQLCDLRLF (PIK3CA R88Q)
TIQLCDLRLF

SEQ ID NO: 16363 - protein, 10 aa, Artificial Sequence
  Description of Artificial Sequence: Synthetic peptide
  Seed: TRQLCDLRLF (PIK3CA R88Q)
TIQLCDLRLY

SEQ ID NO: 16364 - protein, 10 aa, Artificial Sequence
  Description of Artificial Sequence: Synthetic peptide
  Seed: TRQLCDLRLF (PIK3CA R88Q)
TKQLCDLRLF

SEQ ID NO: 16365 - protein, 10 aa, Artificial Sequence
  Description of Artificial Sequence: Synthetic peptide
  Seed: TRQLCDLRLF (PIK3CA R88Q)
TKQLCDLRLY

SEQ ID NO: 16366 - protein, 10 aa, Artificial Sequence
  Description of Artificial Sequence: Synthetic peptide
  Seed: TRQLCDLRLF (PIK3CA R88Q)
TLQLCDLRLF

SEQ ID NO: 16367 - protein, 10 aa, Artificial Sequence
  Description of Artificial Sequence: Synthetic peptide
  Seed: TRQLCDLRLF (PIK3CA R88Q)
TLQLCDLRLY

SEQ ID NO: 16368 - protein, 10 aa, Artificial Sequence
  Description of Artificial Sequence: Synthetic peptide
  Seed: TRQLCDLRLF (PIK3CA R88Q)
TMQLCDLRLF

SEQ ID NO: 16369 - protein, 10 aa, Artificial Sequence
  Description of Artificial Sequence: Synthetic peptide
  Seed: TRQLCDLRLF (PIK3CA R88Q)
TMQLCDLRLM

SEQ ID NO: 16370 - protein, 10 aa, Artificial Sequence
  Description of Artificial Sequence: Synthetic peptide
  Seed: TRQLCDLRLF (PIK3CA R88Q)
TMQLCDLRLY

SEQ ID NO: 16371 - protein, 10 aa, Artificial Sequence
  Description of Artificial Sequence: Synthetic peptide
  Seed: TRQLCDLRLF (PIK3CA R88Q)
TNQLCDLRLF

SEQ ID NO: 16372 - protein, 10 aa, Artificial Sequence
  Description of Artificial Sequence: Synthetic peptide
  Seed: TRQLCDLRLF (PIK3CA R88Q)
TNQLCDLRLY

SEQ ID NO: 16373 - protein, 10 aa, Artificial Sequence
  Description of Artificial Sequence: Synthetic peptide
  Seed: TRQLCDLRLF (PIK3CA R88Q)
TPQLCDLRLF

SEQ ID NO: 16374 - protein, 10 aa, Artificial Sequence
  Description of Artificial Sequence: Synthetic peptide
  Seed: TRQLCDLRLF (PIK3CA R88Q)
TPQLCDLRLY

SEQ ID NO: 16375 - protein, 10 aa, Artificial Sequence
  Description of Artificial Sequence: Synthetic peptide
  Seed: TRQLCDLRLF (PIK3CA R88Q)
TQQLCDLRLF

SEQ ID NO: 16376 - protein, 10 aa, Artificial Sequence
  Description of Artificial Sequence: Synthetic peptide
  Seed: TRQLCDLRLF (PIK3CA R88Q)
TQQLCDLRLM

SEQ ID NO: 16377 - protein, 10 aa, Artificial Sequence
  Description of Artificial Sequence: Synthetic peptide
  Seed: TRQLCDLRLF (PIK3CA R88Q)
TQQLCDLRLY

SEQ ID NO: 16378 - protein, 9 aa, Artificial Sequence
  Description of Artificial Sequence: Synthetic peptide
  Seed: TRQLCDLRL (PIK3CA R88Q)
TRQLCDLRF

SEQ ID NO: 16379 - protein, 9 aa, Artificial Sequence
  Description of Artificial Sequence: Synthetic peptide
  Seed: TRQLCDLRL (PIK3CA R88Q)
TRQLCDLRI

SEQ ID NO: 16380 - protein, 9 aa, Artificial Sequence
  Description of Artificial Sequence: Synthetic peptide
  Seed: TRQLCDLRL (PIK3CA R88Q)
TRQLCDLRK

SEQ ID NO: 16381 - protein, 10 aa, Artificial Sequence
  Description of Artificial Sequence: Synthetic peptide
  Seed: TRQLCDLRLF (PIK3CA R88Q)
TRQLCDLRLI

SEQ ID NO: 16382 - protein, 10 aa, Artificial Sequence
  Description of Artificial Sequence: Synthetic peptide
  Seed: TRQLCDLRLF (PIK3CA R88Q)
TRQLCDLRLK

SEQ ID NO: 16383 - protein, 10 aa, Artificial Sequence
  Description of Artificial Sequence: Synthetic peptide
  Seed: TRQLCDLRLF (PIK3CA R88Q)
TRQLCDLRLL

SEQ ID NO: 16384 - protein, 10 aa, Artificial Sequence
  Description of Artificial Sequence: Synthetic peptide
  Seed: TRQLCDLRLF (PIK3CA R88Q)
TRQLCDLRLM

SEQ ID NO: 16385 - protein, 10 aa, Artificial Sequence
  Description of Artificial Sequence: Synthetic peptide
  Seed: TRQLCDLRLF (PIK3CA R88Q)
TRQLCDLRLR

SEQ ID NO: 16386 - protein, 10 aa, Artificial Sequence
  Description of Artificial Sequence: Synthetic peptide
  Seed: TRQLCDLRLF (PIK3CA R88Q)
TRQLCDLRLV

SEQ ID NO: 16387 - protein, 10 aa, Artificial Sequence
  Description of Artificial Sequence: Synthetic peptide
  Seed: TRQLCDLRLF (PIK3CA R88Q)
TRQLCDLRLY

SEQ ID NO: 16388 - protein, 9 aa, Artificial Sequence
  Description of Artificial Sequence: Synthetic peptide
  Seed: TRQLCDLRL (PIK3CA R88Q)
TRQLCDLRM

SEQ ID NO: 16389 - protein, 9 aa, Artificial Sequence
  Description of Artificial Sequence: Synthetic peptide
  Seed: TRQLCDLRL (PIK3CA R88Q)
TRQLCDLRR

SEQ ID NO: 16390 - protein, 9 aa, Artificial Sequence
  Description of Artificial Sequence: Synthetic peptide
  Seed: TRQLCDLRL (PIK3CA R88Q)
TRQLCDLRV

SEQ ID NO: 16391 - protein, 10 aa, Artificial Sequence
  Description of Artificial Sequence: Synthetic peptide
  Seed: TRQLCDLRLF (PIK3CA R88Q)
TSQLCDLRLF

SEQ ID NO: 16392 - protein, 10 aa, Artificial Sequence
  Description of Artificial Sequence: Synthetic peptide
  Seed: TRQLCDLRLF (PIK3CA R88Q)
TSQLCDLRLY

SEQ ID NO: 16393 - protein, 10 aa, Artificial Sequence
  Description of Artificial Sequence: Synthetic peptide
  Seed: TRQLCDLRLF (PIK3CA R88Q)
TTQLCDLRLF

SEQ ID NO: 16394 - protein, 10 aa, Artificial Sequence
  Description of Artificial Sequence: Synthetic peptide
  Seed: TRQLCDLRLF (PIK3CA R88Q)
TTQLCDLRLY

SEQ ID NO: 16395 - protein, 10 aa, Artificial Sequence
  Description of Artificial Sequence: Synthetic peptide
  Seed: TRQLCDLRLF (PIK3CA R88Q)
TVQLCDLRLF

SEQ ID NO: 16396 - protein, 10 aa, Artificial Sequence
  Description of Artificial Sequence: Synthetic peptide
  Seed: TRQLCDLRLF (PIK3CA R88Q)
TVQLCDLRLY

SEQ ID NO: 16397 - protein, 10 aa, Artificial Sequence
  Description of Artificial Sequence: Synthetic peptide
  Seed: TRQLCDLRLF (PIK3CA R88Q)
TWQLCDLRLF

SEQ ID NO: 16398 - protein, 10 aa, Artificial Sequence
  Description of Artificial Sequence: Synthetic peptide
  Seed: TRQLCDLRLF (PIK3CA R88Q)
TWQLCDLRLY

SEQ ID NO: 16399 - protein, 10 aa, Artificial Sequence
  Description of Artificial Sequence: Synthetic peptide
  Seed: TRQLCDLRLF (PIK3CA R88Q)
TYQLCDLRLF

SEQ ID NO: 16400 - protein, 10 aa, Artificial Sequence
  Description of Artificial Sequence: Synthetic peptide
  Seed: TRQLCDLRLF (PIK3CA R88Q)
TYQLCDLRLY

SEQ ID NO: 16401 - protein, 9 aa, Artificial Sequence
  Description of Artificial Sequence: Synthetic peptide
  Seed: DETRQLCDL (PIK3CA R88Q)
DETRQLCDA

SEQ ID NO: 16402 - protein, 9 aa, Artificial Sequence
  Description of Artificial Sequence: Synthetic peptide
  Seed: DETRQLCDL (PIK3CA R88Q)
DETRQLCDF

SEQ ID NO: 16403 - protein, 9 aa, Artificial Sequence
  Description of Artificial Sequence: Synthetic peptide
  Seed: DETRQLCDL (PIK3CA R88Q)
DETRQLCDI

SEQ ID NO: 16404 - protein, 9 aa, Artificial Sequence
  Description of Artificial Sequence: Synthetic peptide
  Seed: DETRQLCDL (PIK3CA R88Q)
DETRQLCDM

SEQ ID NO: 16405 - protein, 9 aa, Artificial Sequence
  Description of Artificial Sequence: Synthetic peptide
  Seed: DETRQLCDL (PIK3CA R88Q)
DETRQLCDV

SEQ ID NO: 16406 - protein, 9 aa, Artificial Sequence
  Description of Artificial Sequence: Synthetic peptide
  Seed: EFFDETRQL (PIK3CA R88Q)
EAFDETRQA

SEQ ID NO: 16407 - protein, 9 aa, Artificial Sequence
  Description of Artificial Sequence: Synthetic peptide
  Seed: EFFDETRQL (PIK3CA R88Q)
EAFDETRQF

SEQ ID NO: 16408 - protein, 9 aa, Artificial Sequence
  Description of Artificial Sequence: Synthetic peptide
  Seed: EFFDETRQL (PIK3CA R88Q)
EAFDETRQH

SEQ ID NO: 16409 - protein, 9 aa, Artificial Sequence
  Description of Artificial Sequence: Synthetic peptide
  Seed: EFFDETRQL (PIK3CA R88Q)
EAFDETRQI

SEQ ID NO: 16410 - protein, 9 aa, Artificial Sequence
  Description of Artificial Sequence: Synthetic peptide
  Seed: EFFDETRQL (PIK3CA R88Q)
EAFDETRQK

SEQ ID NO: 16411 - protein, 9 aa, Artificial Sequence
  Description of Artificial Sequence: Synthetic peptide
  Seed: EFFDETRQL (PIK3CA R88Q)
EAFDETRQL

SEQ ID NO: 16412 - protein, 9 aa, Artificial Sequence
  Description of Artificial Sequence: Synthetic peptide
  Seed: EFFDETRQL (PIK3CA R88Q)
EAFDETRQM

SEQ ID NO: 16413 - protein, 9 aa, Artificial Sequence
  Description of Artificial Sequence: Synthetic peptide
  Seed: EFFDETRQL (PIK3CA R88Q)
EAFDETRQR

SEQ ID NO: 16414 - protein, 9 aa, Artificial Sequence
  Description of Artificial Sequence: Synthetic peptide
  Seed: EFFDETRQL (PIK3CA R88Q)
EAFDETRQV

SEQ ID NO: 16415 - protein, 9 aa, Artificial Sequence
  Description of Artificial Sequence: Synthetic peptide
  Seed: EFFDETRQL (PIK3CA R88Q)
EAFDETRQW

SEQ ID NO: 16416 - protein, 10 aa, Artificial Sequence
  Description of Artificial Sequence: Synthetic peptide
  Seed: EEFFDETRQL (PIK3CA R88Q)
EAFFDETRQW

SEQ ID NO: 16417 - protein, 11 aa, Artificial Sequence
  Description of Artificial Sequence: Synthetic peptide
  Seed: ETRQLCDLRLF (PIK3CA R88Q)
EARQLCDLRLW

SEQ ID NO: 16418 - protein, 9 aa, Artificial Sequence
  Description of Artificial Sequence: Synthetic peptide
  Seed: ETRQLCDLR (PIK3CA R88Q)
EARQLCDLY

SEQ ID NO: 16419 - protein, 9 aa, Artificial Sequence
  Description of Artificial Sequence: Synthetic peptide
  Seed: EFFDETRQL (PIK3CA R88Q)
ECFDETRQF

SEQ ID NO: 16420 - protein, 9 aa, Artificial Sequence
  Description of Artificial Sequence: Synthetic peptide
  Seed: EFFDETRQL (PIK3CA R88Q)
ECFDETRQK

SEQ ID NO: 16421 - protein, 9 aa, Artificial Sequence
  Description of Artificial Sequence: Synthetic peptide
  Seed: EFFDETRQL (PIK3CA R88Q)
ECFDETRQL

SEQ ID NO: 16422 - protein, 9 aa, Artificial Sequence
  Description of Artificial Sequence: Synthetic peptide
  Seed: EFFDETRQL (PIK3CA R88Q)
ECFDETRQM

SEQ ID NO: 16423 - protein, 9 aa, Artificial Sequence
  Description of Artificial Sequence: Synthetic peptide
  Seed: EFFDETRQL (PIK3CA R88Q)
ECFDETRQR

SEQ ID NO: 16424 - protein, 9 aa, Artificial Sequence
  Description of Artificial Sequence: Synthetic peptide
  Seed: EFFDETRQL (PIK3CA R88Q)
ECFDETRQY

SEQ ID NO: 16425 - protein, 9 aa, Artificial Sequence
  Description of Artificial Sequence: Synthetic peptide
  Seed: ETRQLCDLR (PIK3CA R88Q)
ECRQLCDLR

SEQ ID NO: 16426 - protein, 11 aa, Artificial Sequence
  Description of Artificial Sequence: Synthetic peptide
  Seed: ETRQLCDLRLF (PIK3CA R88Q)
ECRQLCDLRLW

SEQ ID NO: 16427 - protein, 9 aa, Artificial Sequence
  Description of Artificial Sequence: Synthetic peptide
  Seed: EFFDETRQL (PIK3CA R88Q)
EDFDETRQK

SEQ ID NO: 16428 - protein, 9 aa, Artificial Sequence
  Description of Artificial Sequence: Synthetic peptide
  Seed: EFFDETRQL (PIK3CA R88Q)
EDFDETRQL

SEQ ID NO: 16429 - protein, 9 aa, Artificial Sequence
  Description of Artificial Sequence: Synthetic peptide
  Seed: EFFDETRQL (PIK3CA R88Q)
EDFDETRQM

SEQ ID NO: 16430 - protein, 9 aa, Artificial Sequence
  Description of Artificial Sequence: Synthetic peptide
  Seed: EFFDETRQL (PIK3CA R88Q)
EDFDETRQR

SEQ ID NO: 16431 - protein, 10 aa, Artificial Sequence
  Description of Artificial Sequence: Synthetic peptide
  Seed: EEFFDETRQL (PIK3CA R88Q)
EDFFDETRQF

SEQ ID NO: 16432 - protein, 11 aa, Artificial Sequence
  Description of Artificial Sequence: Synthetic peptide
  Seed: EEFFDETRQLC (PIK3CA R88Q)
EDFFDETRQLF

SEQ ID NO: 16433 - protein, 11 aa, Artificial Sequence
  Description of Artificial Sequence: Synthetic peptide
  Seed: EEFFDETRQLC (PIK3CA R88Q)
EDFFDETRQLW

SEQ ID NO: 16434 - protein, 11 aa, Artificial Sequence
  Description of Artificial Sequence: Synthetic peptide
  Seed: EEFFDETRQLC (PIK3CA R88Q)
EDFFDETRQLY

SEQ ID NO: 16435 - protein, 10 aa, Artificial Sequence
  Description of Artificial Sequence: Synthetic peptide
  Seed: EEFFDETRQL (PIK3CA R88Q)
EDFFDETRQW

SEQ ID NO: 16436 - protein, 10 aa, Artificial Sequence
  Description of Artificial Sequence: Synthetic peptide
  Seed: EEFFDETRQL (PIK3CA R88Q)
EDFFDETRQY

SEQ ID NO: 16437 - protein, 9 aa, Artificial Sequence
  Description of Artificial Sequence: Synthetic peptide
  Seed: ETRQLCDLR (PIK3CA R88Q)
EDRQLCDLR

SEQ ID NO: 16438 - protein, 9 aa, Artificial Sequence
  Description of Artificial Sequence: Synthetic peptide
  Seed: EFFDETRQL (PIK3CA R88Q)
EEFDETRQF

SEQ ID NO: 16439 - protein, 9 aa, Artificial Sequence
  Description of Artificial Sequence: Synthetic peptide
  Seed: EFFDETRQL (PIK3CA R88Q)
EEFDETRQI

SEQ ID NO: 16440 - protein, 9 aa, Artificial Sequence
  Description of Artificial Sequence: Synthetic peptide
  Seed: EFFDETRQL (PIK3CA R88Q)
EEFDETRQK

SEQ ID NO: 16441 - protein, 9 aa, Artificial Sequence
  Description of Artificial Sequence: Synthetic peptide
  Seed: EFFDETRQL (PIK3CA R88Q)
EEFDETRQL

SEQ ID NO: 16442 - protein, 9 aa, Artificial Sequence
  Description of Artificial Sequence: Synthetic peptide
  Seed: EFFDETRQL (PIK3CA R88Q)
EEFDETRQM

SEQ ID NO: 16443 - protein, 9 aa, Artificial Sequence
  Description of Artificial Sequence: Synthetic peptide
  Seed: EFFDETRQL (PIK3CA R88Q)
EEFDETRQR

SEQ ID NO: 16444 - protein, 9 aa, Artificial Sequence
  Description of Artificial Sequence: Synthetic peptide
  Seed: EFFDETRQL (PIK3CA R88Q)
EEFDETRQV

SEQ ID NO: 16445 - protein, 9 aa, Artificial Sequence
  Description of Artificial Sequence: Synthetic peptide
  Seed: EFFDETRQL (PIK3CA R88Q)
EEFDETRQY

SEQ ID NO: 16446 - protein, 10 aa, Artificial Sequence
  Description of Artificial Sequence: Synthetic peptide
  Seed: EEFFDETRQL (PIK3CA R88Q)
EEFFDETRQA

SEQ ID NO: 16447 - protein, 10 aa, Artificial Sequence
  Description of Artificial Sequence: Synthetic peptide
  Seed: EEFFDETRQL (PIK3CA R88Q)
EEFFDETRQC

SEQ ID NO: 16448 - protein, 10 aa, Artificial Sequence
  Description of Artificial Sequence: Synthetic peptide
  Seed: EEFFDETRQL (PIK3CA R88Q)
EEFFDETRQF

SEQ ID NO: 16449 - protein, 10 aa, Artificial Sequence
  Description of Artificial Sequence: Synthetic peptide
  Seed: EEFFDETRQL (PIK3CA R88Q)
EEFFDETRQG

SEQ ID NO: 16450 - protein, 10 aa, Artificial Sequence
  Description of Artificial Sequence: Synthetic peptide
  Seed: EEFFDETRQL (PIK3CA R88Q)
EEFFDETRQH

SEQ ID NO: 16451 - protein, 10 aa, Artificial Sequence
  Description of Artificial Sequence: Synthetic peptide
  Seed: EEFFDETRQL (PIK3CA R88Q)
EEFFDETRQI

SEQ ID NO: 16452 - protein, 10 aa, Artificial Sequence
  Description of Artificial Sequence: Synthetic peptide
  Seed: EEFFDETRQL (PIK3CA R88Q)
EEFFDETRQK

SEQ ID NO: 16453 - protein, 11 aa, Artificial Sequence
  Description of Artificial Sequence: Synthetic peptide
  Seed: EEFFDETRQLC (PIK3CA R88Q)
EEFFDETRQLA

SEQ ID NO: 16454 - protein, 11 aa, Artificial Sequence
  Description of Artificial Sequence: Synthetic peptide
  Seed: EEFFDETRQLC (PIK3CA R88Q)
EEFFDETRQLF

SEQ ID NO: 16455 - protein, 11 aa, Artificial Sequence
  Description of Artificial Sequence: Synthetic peptide
  Seed: EEFFDETRQLC (PIK3CA R88Q)
EEFFDETRQLH

SEQ ID NO: 16456 - protein, 11 aa, Artificial Sequence
  Description of Artificial Sequence: Synthetic peptide
  Seed: EEFFDETRQLC (PIK3CA R88Q)
EEFFDETRQLI

SEQ ID NO: 16457 - protein, 11 aa, Artificial Sequence
  Description of Artificial Sequence: Synthetic peptide
  Seed: EEFFDETRQLC (PIK3CA R88Q)
EEFFDETRQLL

SEQ ID NO: 16458 - protein, 11 aa, Artificial Sequence
  Description of Artificial Sequence: Synthetic peptide
  Seed: EEFFDETRQLC (PIK3CA R88Q)
EEFFDETRQLM

SEQ ID NO: 16459 - protein, 11 aa, Artificial Sequence
  Description of Artificial Sequence: Synthetic peptide
  Seed: EEFFDETRQLC (PIK3CA R88Q)
EEFFDETRQLP

SEQ ID NO: 16460 - protein, 11 aa, Artificial Sequence
  Description of Artificial Sequence: Synthetic peptide
  Seed: EEFFDETRQLC (PIK3CA R88Q)
EEFFDETRQLT

SEQ ID NO: 16461 - protein, 11 aa, Artificial Sequence
  Description of Artificial Sequence: Synthetic peptide
  Seed: EEFFDETRQLC (PIK3CA R88Q)
EEFFDETRQLV

SEQ ID NO: 16462 - protein, 11 aa, Artificial Sequence
  Description of Artificial Sequence: Synthetic peptide
  Seed: EEFFDETRQLC (PIK3CA R88Q)
EEFFDETRQLW

SEQ ID NO: 16463 - protein, 11 aa, Artificial Sequence
  Description of Artificial Sequence: Synthetic peptide
  Seed: EEFFDETRQLC (PIK3CA R88Q)
EEFFDETRQLY

SEQ ID NO: 16464 - protein, 10 aa, Artificial Sequence
  Description of Artificial Sequence: Synthetic peptide
  Seed: EEFFDETRQL (PIK3CA R88Q)
EEFFDETRQM

SEQ ID NO: 16465 - protein, 10 aa, Artificial Sequence
  Description of Artificial Sequence: Synthetic peptide
  Seed: EEFFDETRQL (PIK3CA R88Q)
EEFFDETRQP

SEQ ID NO: 16466 - protein, 10 aa, Artificial Sequence
  Description of Artificial Sequence: Synthetic peptide
  Seed: EEFFDETRQL (PIK3CA R88Q)
EEFFDETRQR

SEQ ID NO: 16467 - protein, 10 aa, Artificial Sequence
  Description of Artificial Sequence: Synthetic peptide
  Seed: EEFFDETRQL (PIK3CA R88Q)
EEFFDETRQS

SEQ ID NO: 16468 - protein, 10 aa, Artificial Sequence
  Description of Artificial Sequence: Synthetic peptide
  Seed: EEFFDETRQL (PIK3CA R88Q)
EEFFDETRQT

SEQ ID NO: 16469 - protein, 10 aa, Artificial Sequence
  Description of Artificial Sequence: Synthetic peptide
  Seed: EEFFDETRQL (PIK3CA R88Q)
EEFFDETRQV

SEQ ID NO: 16470 - protein, 10 aa, Artificial Sequence
  Description of Artificial Sequence: Synthetic peptide
  Seed: EEFFDETRQL (PIK3CA R88Q)
EEFFDETRQW

SEQ ID NO: 16471 - protein, 10 aa, Artificial Sequence
  Description of Artificial Sequence: Synthetic peptide
  Seed: EEFFDETRQL (PIK3CA R88Q)
EEFFDETRQY

SEQ ID NO: 16472 - protein, 9 aa, Artificial Sequence
  Description of Artificial Sequence: Synthetic peptide
  Seed: ETRQLCDLR (PIK3CA R88Q)
EERQLCDLR

SEQ ID NO: 16473 - protein, 9 aa, Artificial Sequence
  Description of Artificial Sequence: Synthetic peptide
  Seed: EFFDETRQL (PIK3CA R88Q)
EFFDETRQI

SEQ ID NO: 16474 - protein, 9 aa, Artificial Sequence
  Description of Artificial Sequence: Synthetic peptide
  Seed: EFFDETRQL (PIK3CA R88Q)
EFFDETRQK

SEQ ID NO: 16475 - protein, 9 aa, Artificial Sequence
  Description of Artificial Sequence: Synthetic peptide
  Seed: EFFDETRQL (PIK3CA R88Q)
EFFDETRQR

SEQ ID NO: 16476 - protein, 9 aa, Artificial Sequence
  Description of Artificial Sequence: Synthetic peptide
  Seed: EFFDETRQL (PIK3CA R88Q)
EFFDETRQV

SEQ ID NO: 16477 - protein, 9 aa, Artificial Sequence
  Description of Artificial Sequence: Synthetic peptide
  Seed: EFFDETRQL (PIK3CA R88Q)
EFFDETRQW

SEQ ID NO: 16478 - protein, 9 aa, Artificial Sequence
  Description of Artificial Sequence: Synthetic peptide
  Seed: ETRQLCDLR (PIK3CA R88Q)
EFRQLCDLK

SEQ ID NO: 16479 - protein, 9 aa, Artificial Sequence
  Description of Artificial Sequence: Synthetic peptide
  Seed: EFFDETRQL (PIK3CA R88Q)
EGFDETRQF

SEQ ID NO: 16480 - protein, 9 aa, Artificial Sequence
  Description of Artificial Sequence: Synthetic peptide
  Seed: EFFDETRQL (PIK3CA R88Q)
EGFDETRQI

SEQ ID NO: 16481 - protein, 9 aa, Artificial Sequence
  Description of Artificial Sequence: Synthetic peptide
  Seed: EFFDETRQL (PIK3CA R88Q)
EGFDETRQK

SEQ ID NO: 16482 - protein, 9 aa, Artificial Sequence
  Description of Artificial Sequence: Synthetic peptide
  Seed: EFFDETRQL (PIK3CA R88Q)
EGFDETRQL

SEQ ID NO: 16483 - protein, 9 aa, Artificial Sequence
  Description of Artificial Sequence: Synthetic peptide
  Seed: EFFDETRQL (PIK3CA R88Q)
EGFDETRQM

SEQ ID NO: 16484 - protein, 9 aa, Artificial Sequence
  Description of Artificial Sequence: Synthetic peptide
  Seed: EFFDETRQL (PIK3CA R88Q)
EGFDETRQR

SEQ ID NO: 16485 - protein, 9 aa, Artificial Sequence
  Description of Artificial Sequence: Synthetic peptide
  Seed: EFFDETRQL (PIK3CA R88Q)
EGFDETRQV

SEQ ID NO: 16486 - protein, 9 aa, Artificial Sequence
  Description of Artificial Sequence: Synthetic peptide
  Seed: EFFDETRQL (PIK3CA R88Q)
EGFDETRQY

SEQ ID NO: 16487 - protein, 9 aa, Artificial Sequence
  Description of Artificial Sequence: Synthetic peptide
  Seed: ETRQLCDLR (PIK3CA R88Q)
EGRQLCDLK

SEQ ID NO: 16488 - protein, 11 aa, Artificial Sequence
  Description of Artificial Sequence: Synthetic peptide
  Seed: ETRQLCDLRLF (PIK3CA R88Q)
EGRQLCDLRLW

SEQ ID NO: 16489 - protein, 9 aa, Artificial Sequence
  Description of Artificial Sequence: Synthetic peptide
  Seed: EFFDETRQL (PIK3CA R88Q)
EHFDETRQF

SEQ ID NO: 16490 - protein, 9 aa, Artificial Sequence
  Description of Artificial Sequence: Synthetic peptide
  Seed: EFFDETRQL (PIK3CA R88Q)
EHFDETRQI

SEQ ID NO: 16491 - protein, 9 aa, Artificial Sequence
  Description of Artificial Sequence: Synthetic peptide
  Seed: EFFDETRQL (PIK3CA R88Q)
EHFDETRQK

SEQ ID NO: 16492 - protein, 9 aa, Artificial Sequence
  Description of Artificial Sequence: Synthetic peptide
  Seed: EFFDETRQL (PIK3CA R88Q)
EHFDETRQL

SEQ ID NO: 16493 - protein, 9 aa, Artificial Sequence
  Description of Artificial Sequence: Synthetic peptide
  Seed: EFFDETRQL (PIK3CA R88Q)
EHFDETRQM

SEQ ID NO: 16494 - protein, 9 aa, Artificial Sequence
  Description of Artificial Sequence: Synthetic peptide
  Seed: EFFDETRQL (PIK3CA R88Q)
EHFDETRQV

SEQ ID NO: 16495 - protein, 9 aa, Artificial Sequence
  Description of Artificial Sequence: Synthetic peptide
  Seed: EFFDETRQL (PIK3CA R88Q)
EHFDETRQY

SEQ ID NO: 16496 - protein, 10 aa, Artificial Sequence
  Description of Artificial Sequence: Synthetic peptide
  Seed: EEFFDETRQL (PIK3CA R88Q)
EHFFDETRQW

SEQ ID NO: 16497 - protein, 9 aa, Artificial Sequence
  Description of Artificial Sequence: Synthetic peptide
  Seed: ETRQLCDLR (PIK3CA R88Q)
EHRQLCDLR

SEQ ID NO: 16498 - protein, 9 aa, Artificial Sequence
  Description of Artificial Sequence: Synthetic peptide
  Seed: EFFDETRQL (PIK3CA R88Q)
EIFDETRQF

SEQ ID NO: 16499 - protein, 9 aa, Artificial Sequence
  Description of Artificial Sequence: Synthetic peptide
  Seed: EFFDETRQL (PIK3CA R88Q)
EIFDETRQI

SEQ ID NO: 16500 - protein, 9 aa, Artificial Sequence
  Description of Artificial Sequence: Synthetic peptide
  Seed: EFFDETRQL (PIK3CA R88Q)
EIFDETRQK

SEQ ID NO: 16501 - protein, 9 aa, Artificial Sequence
  Description of Artificial Sequence: Synthetic peptide
  Seed: EFFDETRQL (PIK3CA R88Q)
EIFDETRQL

SEQ ID NO: 16502 - protein, 9 aa, Artificial Sequence
  Description of Artificial Sequence: Synthetic peptide
  Seed: EFFDETRQL (PIK3CA R88Q)
EIFDETRQM

SEQ ID NO: 16503 - protein, 9 aa, Artificial Sequence
  Description of Artificial Sequence: Synthetic peptide
  Seed: EFFDETRQL (PIK3CA R88Q)
EIFDETRQR

SEQ ID NO: 16504 - protein, 9 aa, Artificial Sequence
  Description of Artificial Sequence: Synthetic peptide
  Seed: EFFDETRQL (PIK3CA R88Q)
EIFDETRQV

SEQ ID NO: 16505 - protein, 9 aa, Artificial Sequence
  Description of Artificial Sequence: Synthetic peptide
  Seed: EFFDETRQL (PIK3CA R88Q)
EIFDETRQW

SEQ ID NO: 16506 - protein, 9 aa, Artificial Sequence
  Description of Artificial Sequence: Synthetic peptide
  Seed: EFFDETRQL (PIK3CA R88Q)
EIFDETRQY

SEQ ID NO: 16507 - protein, 11 aa, Artificial Sequence
  Description of Artificial Sequence: Synthetic peptide
  Seed: ETRQLCDLRLF (PIK3CA R88Q)
EIRQLCDLRLW

SEQ ID NO: 16508 - protein, 9 aa, Artificial Sequence
  Description of Artificial Sequence: Synthetic peptide
  Seed: ETRQLCDLR (PIK3CA R88Q)
EIRQLCDLY

SEQ ID NO: 16509 - protein, 9 aa, Artificial Sequence
  Description of Artificial Sequence: Synthetic peptide
  Seed: EFFDETRQL (PIK3CA R88Q)
EKFDETRQF

SEQ ID NO: 16510 - protein, 9 aa, Artificial Sequence
  Description of Artificial Sequence: Synthetic peptide
  Seed: EFFDETRQL (PIK3CA R88Q)
EKFDETRQL

SEQ ID NO: 16511 - protein, 9 aa, Artificial Sequence
  Description of Artificial Sequence: Synthetic peptide
  Seed: EFFDETRQL (PIK3CA R88Q)
EKFDETRQM

SEQ ID NO: 16512 - protein, 9 aa, Artificial Sequence
  Description of Artificial Sequence: Synthetic peptide
  Seed: EFFDETRQL (PIK3CA R88Q)
EKFDETRQY

SEQ ID NO: 16513 - protein, 10 aa, Artificial Sequence
  Description of Artificial Sequence: Synthetic peptide
  Seed: EEFFDETRQL (PIK3CA R88Q)
EKFFDETRQW

SEQ ID NO: 16514 - protein, 9 aa, Artificial Sequence
  Description of Artificial Sequence: Synthetic peptide
  Seed: ETRQLCDLR (PIK3CA R88Q)
EKRQLCDLR

SEQ ID NO: 16515 - protein, 9 aa, Artificial Sequence
  Description of Artificial Sequence: Synthetic peptide
  Seed: EFFDETRQL (PIK3CA R88Q)
ELFDETRQF

SEQ ID NO: 16516 - protein, 9 aa, Artificial Sequence
  Description of Artificial Sequence: Synthetic peptide
  Seed: EFFDETRQL (PIK3CA R88Q)
ELFDETRQI

SEQ ID NO: 16517 - protein, 9 aa, Artificial Sequence
  Description of Artificial Sequence: Synthetic peptide
  Seed: EFFDETRQL (PIK3CA R88Q)
ELFDETRQK

SEQ ID NO: 16518 - protein, 9 aa, Artificial Sequence
  Description of Artificial Sequence: Synthetic peptide
  Seed: EFFDETRQL (PIK3CA R88Q)
ELFDETRQL

SEQ ID NO: 16519 - protein, 9 aa, Artificial Sequence
  Description of Artificial Sequence: Synthetic peptide
  Seed: EFFDETRQL (PIK3CA R88Q)
ELFDETRQM

SEQ ID NO: 16520 - protein, 9 aa, Artificial Sequence
  Description of Artificial Sequence: Synthetic peptide
  Seed: EFFDETRQL (PIK3CA R88Q)
ELFDETRQR

SEQ ID NO: 16521 - protein, 9 aa, Artificial Sequence
  Description of Artificial Sequence: Synthetic peptide
  Seed: EFFDETRQL (PIK3CA R88Q)
ELFDETRQV

SEQ ID NO: 16522 - protein, 9 aa, Artificial Sequence
  Description of Artificial Sequence: Synthetic peptide
  Seed: EFFDETRQL (PIK3CA R88Q)
ELFDETRQW

SEQ ID NO: 16523 - protein, 9 aa, Artificial Sequence
  Description of Artificial Sequence: Synthetic peptide
  Seed: EFFDETRQL (PIK3CA R88Q)
ELFDETRQY

SEQ ID NO: 16524 - protein, 11 aa, Artificial Sequence
  Description of Artificial Sequence: Synthetic peptide
  Seed: ETRQLCDLRLF (PIK3CA R88Q)
ELRQLCDLRLW

SEQ ID NO: 16525 - protein, 9 aa, Artificial Sequence
  Description of Artificial Sequence: Synthetic peptide
  Seed: EFFDETRQL (PIK3CA R88Q)
EMFDETRQF

SEQ ID NO: 16526 - protein, 9 aa, Artificial Sequence
  Description of Artificial Sequence: Synthetic peptide
  Seed: EFFDETRQL (PIK3CA R88Q)
EMFDETRQI

SEQ ID NO: 16527 - protein, 9 aa, Artificial Sequence
  Description of Artificial Sequence: Synthetic peptide
  Seed: EFFDETRQL (PIK3CA R88Q)
EMFDETRQK

SEQ ID NO: 16528 - protein, 9 aa, Artificial Sequence
  Description of Artificial Sequence: Synthetic peptide
  Seed: EFFDETRQL (PIK3CA R88Q)
EMFDETRQL

SEQ ID NO: 16529 - protein, 9 aa, Artificial Sequence
  Description of Artificial Sequence: Synthetic peptide
  Seed: EFFDETRQL (PIK3CA R88Q)
EMFDETRQM

SEQ ID NO: 16530 - protein, 9 aa, Artificial Sequence
  Description of Artificial Sequence: Synthetic peptide
  Seed: EFFDETRQL (PIK3CA R88Q)
EMFDETRQR

SEQ ID NO: 16531 - protein, 9 aa, Artificial Sequence
  Description of Artificial Sequence: Synthetic peptide
  Seed: EFFDETRQL (PIK3CA R88Q)
EMFDETRQV

SEQ ID NO: 16532 - protein, 9 aa, Artificial Sequence
  Description of Artificial Sequence: Synthetic peptide
  Seed: EFFDETRQL (PIK3CA R88Q)
EMFDETRQW

SEQ ID NO: 16533 - protein, 9 aa, Artificial Sequence
  Description of Artificial Sequence: Synthetic peptide
  Seed: EFFDETRQL (PIK3CA R88Q)
EMFDETRQY

SEQ ID NO: 16534 - protein, 11 aa, Artificial Sequence
  Description of Artificial Sequence: Synthetic peptide
  Seed: ETRQLCDLRLF (PIK3CA R88Q)
EMRQLCDLRLW

SEQ ID NO: 16535 - protein, 9 aa, Artificial Sequence
  Description of Artificial Sequence: Synthetic peptide
  Seed: EFFDETRQL (PIK3CA R88Q)
ENFDETRQF

SEQ ID NO: 16536 - protein, 9 aa, Artificial Sequence
  Description of Artificial Sequence: Synthetic peptide
  Seed: EFFDETRQL (PIK3CA R88Q)
ENFDETRQI

SEQ ID NO: 16537 - protein, 9 aa, Artificial Sequence
  Description of Artificial Sequence: Synthetic peptide
  Seed: EFFDETRQL (PIK3CA R88Q)
ENFDETRQK

SEQ ID NO: 16538 - protein, 9 aa, Artificial Sequence
  Description of Artificial Sequence: Synthetic peptide
  Seed: EFFDETRQL (PIK3CA R88Q)
ENFDETRQL

SEQ ID NO: 16539 - protein, 9 aa, Artificial Sequence
  Description of Artificial Sequence: Synthetic peptide
  Seed: EFFDETRQL (PIK3CA R88Q)
ENFDETRQM

SEQ ID NO: 16540 - protein, 9 aa, Artificial Sequence
  Description of Artificial Sequence: Synthetic peptide
  Seed: EFFDETRQL (PIK3CA R88Q)
ENFDETRQR

SEQ ID NO: 16541 - protein, 9 aa, Artificial Sequence
  Description of Artificial Sequence: Synthetic peptide
  Seed: EFFDETRQL (PIK3CA R88Q)
ENFDETRQY

SEQ ID NO: 16542 - protein, 10 aa, Artificial Sequence
  Description of Artificial Sequence: Synthetic peptide
  Seed: EEFFDETRQL (PIK3CA R88Q)
ENFFDETRQW

SEQ ID NO: 16543 - protein, 9 aa, Artificial Sequence
  Description of Artificial Sequence: Synthetic peptide
  Seed: ETRQLCDLR (PIK3CA R88Q)
ENRQLCDLK

SEQ ID NO: 16544 - protein, 11 aa, Artificial Sequence
  Description of Artificial Sequence: Synthetic peptide
  Seed: ETRQLCDLRLF (PIK3CA R88Q)
ENRQLCDLRLW

SEQ ID NO: 16545 - protein, 9 aa, Artificial Sequence
  Description of Artificial Sequence: Synthetic peptide
  Seed: EFFDETRQL (PIK3CA R88Q)
EPFDETRQK

SEQ ID NO: 16546 - protein, 9 aa, Artificial Sequence
  Description of Artificial Sequence: Synthetic peptide
  Seed: EFFDETRQL (PIK3CA R88Q)
EPFDETRQL

SEQ ID NO: 16547 - protein, 9 aa, Artificial Sequence
  Description of Artificial Sequence: Synthetic peptide
  Seed: EFFDETRQL (PIK3CA R88Q)
EPFDETRQY

SEQ ID NO: 16548 - protein, 9 aa, Artificial Sequence
  Description of Artificial Sequence: Synthetic peptide
  Seed: ETRQLCDLR (PIK3CA R88Q)
EPRQLCDLR

SEQ ID NO: 16549 - protein, 9 aa, Artificial Sequence
  Description of Artificial Sequence: Synthetic peptide
  Seed: EFFDETRQL (PIK3CA R88Q)
EQFDETRQF

SEQ ID NO: 16550 - protein, 9 aa, Artificial Sequence
  Description of Artificial Sequence: Synthetic peptide
  Seed: EFFDETRQL (PIK3CA R88Q)
EQFDETRQI

SEQ ID NO: 16551 - protein, 9 aa, Artificial Sequence
  Description of Artificial Sequence: Synthetic peptide
  Seed: EFFDETRQL (PIK3CA R88Q)
EQFDETRQK

SEQ ID NO: 16552 - protein, 9 aa, Artificial Sequence
  Description of Artificial Sequence: Synthetic peptide
  Seed: EFFDETRQL (PIK3CA R88Q)
EQFDETRQL

SEQ ID NO: 16553 - protein, 9 aa, Artificial Sequence
  Description of Artificial Sequence: Synthetic peptide
  Seed: EFFDETRQL (PIK3CA R88Q)
EQFDETRQM

SEQ ID NO: 16554 - protein, 9 aa, Artificial Sequence
  Description of Artificial Sequence: Synthetic peptide
  Seed: EFFDETRQL (PIK3CA R88Q)
EQFDETRQR

SEQ ID NO: 16555 - protein, 9 aa, Artificial Sequence
  Description of Artificial Sequence: Synthetic peptide
  Seed: EFFDETRQL (PIK3CA R88Q)
EQFDETRQV

SEQ ID NO: 16556 - protein, 9 aa, Artificial Sequence
  Description of Artificial Sequence: Synthetic peptide
  Seed: EFFDETRQL (PIK3CA R88Q)
EQFDETRQW

SEQ ID NO: 16557 - protein, 9 aa, Artificial Sequence
  Description of Artificial Sequence: Synthetic peptide
  Seed: EFFDETRQL (PIK3CA R88Q)
EQFDETRQY

SEQ ID NO: 16558 - protein, 10 aa, Artificial Sequence
  Description of Artificial Sequence: Synthetic peptide
  Seed: EEFFDETRQL (PIK3CA R88Q)
EQFFDETRQA

SEQ ID NO: 16559 - protein, 10 aa, Artificial Sequence
  Description of Artificial Sequence: Synthetic peptide
  Seed: EEFFDETRQL (PIK3CA R88Q)
EQFFDETRQF

SEQ ID NO: 16560 - protein, 10 aa, Artificial Sequence
  Description of Artificial Sequence: Synthetic peptide
  Seed: EEFFDETRQL (PIK3CA R88Q)
EQFFDETRQI

SEQ ID NO: 16561 - protein, 10 aa, Artificial Sequence
  Description of Artificial Sequence: Synthetic peptide
  Seed: EEFFDETRQL (PIK3CA R88Q)
EQFFDETRQL

SEQ ID NO: 16562 - protein, 11 aa, Artificial Sequence
  Description of Artificial Sequence: Synthetic peptide
  Seed: EEFFDETRQLC (PIK3CA R88Q)
EQFFDETRQLW

SEQ ID NO: 16563 - protein, 10 aa, Artificial Sequence
  Description of Artificial Sequence: Synthetic peptide
  Seed: EEFFDETRQL (PIK3CA R88Q)
EQFFDETRQW

SEQ ID NO: 16564 - protein, 10 aa, Artificial Sequence
  Description of Artificial Sequence: Synthetic peptide
  Seed: EEFFDETRQL (PIK3CA R88Q)
EQFFDETRQY

SEQ ID NO: 16565 - protein, 9 aa, Artificial Sequence
  Description of Artificial Sequence: Synthetic peptide
  Seed: ETRQLCDLR (PIK3CA R88Q)
EQRQLCDLK

SEQ ID NO: 16566 - protein, 9 aa, Artificial Sequence
  Description of Artificial Sequence: Synthetic peptide
  Seed: ETRQLCDLR (PIK3CA R88Q)
EQRQLCDLR

SEQ ID NO: 16567 - protein, 11 aa, Artificial Sequence
  Description of Artificial Sequence: Synthetic peptide
  Seed: ETRQLCDLRLF (PIK3CA R88Q)
EQRQLCDLRLW

SEQ ID NO: 16568 - protein, 9 aa, Artificial Sequence
  Description of Artificial Sequence: Synthetic peptide
  Seed: EFFDETRQL (PIK3CA R88Q)
ERFDETRQA

SEQ ID NO: 16569 - protein, 9 aa, Artificial Sequence
  Description of Artificial Sequence: Synthetic peptide
  Seed: EFFDETRQL (PIK3CA R88Q)
ERFDETRQC

SEQ ID NO: 16570 - protein, 9 aa, Artificial Sequence
  Description of Artificial Sequence: Synthetic peptide
  Seed: EFFDETRQL (PIK3CA R88Q)
ERFDETRQF

SEQ ID NO: 16571 - protein, 9 aa, Artificial Sequence
  Description of Artificial Sequence: Synthetic peptide
  Seed: EFFDETRQL (PIK3CA R88Q)
ERFDETRQH

SEQ ID NO: 16572 - protein, 9 aa, Artificial Sequence
  Description of Artificial Sequence: Synthetic peptide
  Seed: EFFDETRQL (PIK3CA R88Q)
ERFDETRQI

SEQ ID NO: 16573 - protein, 9 aa, Artificial Sequence
  Description of Artificial Sequence: Synthetic peptide
  Seed: EFFDETRQL (PIK3CA R88Q)
ERFDETRQK

SEQ ID NO: 16574 - protein, 9 aa, Artificial Sequence
  Description of Artificial Sequence: Synthetic peptide
  Seed: EFFDETRQL (PIK3CA R88Q)
ERFDETRQL

SEQ ID NO: 16575 - protein, 9 aa, Artificial Sequence
  Description of Artificial Sequence: Synthetic peptide
  Seed: EFFDETRQL (PIK3CA R88Q)
ERFDETRQM

SEQ ID NO: 16576 - protein, 9 aa, Artificial Sequence
  Description of Artificial Sequence: Synthetic peptide
  Seed: EFFDETRQL (PIK3CA R88Q)
ERFDETRQR

SEQ ID NO: 16577 - protein, 9 aa, Artificial Sequence
  Description of Artificial Sequence: Synthetic peptide
  Seed: EFFDETRQL (PIK3CA R88Q)
ERFDETRQV

SEQ ID NO: 16578 - protein, 9 aa, Artificial Sequence
  Description of Artificial Sequence: Synthetic peptide
  Seed: EFFDETRQL (PIK3CA R88Q)
ERFDETRQW

SEQ ID NO: 16579 - protein, 9 aa, Artificial Sequence
  Description of Artificial Sequence: Synthetic peptide
  Seed: EFFDETRQL (PIK3CA R88Q)
ERFDETRQY

SEQ ID NO: 16580 - protein, 10 aa, Artificial Sequence
  Description of Artificial Sequence: Synthetic peptide
  Seed: EEFFDETRQL (PIK3CA R88Q)
ERFFDETRQW

SEQ ID NO: 16581 - protein, 9 aa, Artificial Sequence
  Description of Artificial Sequence: Synthetic peptide
  Seed: EFFDETRQL (PIK3CA R88Q)
ESFDETRQF

SEQ ID NO: 16582 - protein, 9 aa, Artificial Sequence
  Description of Artificial Sequence: Synthetic peptide
  Seed: EFFDETRQL (PIK3CA R88Q)
ESFDETRQI

SEQ ID NO: 16583 - protein, 9 aa, Artificial Sequence
  Description of Artificial Sequence: Synthetic peptide
  Seed: EFFDETRQL (PIK3CA R88Q)
ESFDETRQK

SEQ ID NO: 16584 - protein, 9 aa, Artificial Sequence
  Description of Artificial Sequence: Synthetic peptide
  Seed: EFFDETRQL (PIK3CA R88Q)
ESFDETRQL

SEQ ID NO: 16585 - protein, 9 aa, Artificial Sequence
  Description of Artificial Sequence: Synthetic peptide
  Seed: EFFDETRQL (PIK3CA R88Q)
ESFDETRQM

SEQ ID NO: 16586 - protein, 9 aa, Artificial Sequence
  Description of Artificial Sequence: Synthetic peptide
  Seed: EFFDETRQL (PIK3CA R88Q)
ESFDETRQR

SEQ ID NO: 16587 - protein, 9 aa, Artificial Sequence
  Description of Artificial Sequence: Synthetic peptide
  Seed: EFFDETRQL (PIK3CA R88Q)
ESFDETRQV

SEQ ID NO: 16588 - protein, 9 aa, Artificial Sequence
  Description of Artificial Sequence: Synthetic peptide
  Seed: EFFDETRQL (PIK3CA R88Q)
ESFDETRQW

SEQ ID NO: 16589 - protein, 9 aa, Artificial Sequence
  Description of Artificial Sequence: Synthetic peptide
  Seed: EFFDETRQL (PIK3CA R88Q)
ESFDETRQY

SEQ ID NO: 16590 - protein, 10 aa, Artificial Sequence
  Description of Artificial Sequence: Synthetic peptide
  Seed: EEFFDETRQL (PIK3CA R88Q)
ESFFDETRQW

SEQ ID NO: 16591 - protein, 11 aa, Artificial Sequence
  Description of Artificial Sequence: Synthetic peptide
  Seed: ETRQLCDLRLF (PIK3CA R88Q)
ESRQLCDLRLF

SEQ ID NO: 16592 - protein, 11 aa, Artificial Sequence
  Description of Artificial Sequence: Synthetic peptide
  Seed: ETRQLCDLRLF (PIK3CA R88Q)
ESRQLCDLRLW

SEQ ID NO: 16593 - protein, 9 aa, Artificial Sequence
  Description of Artificial Sequence: Synthetic peptide
  Seed: EFFDETRQL (PIK3CA R88Q)
ETFDETRQF

SEQ ID NO: 16594 - protein, 9 aa, Artificial Sequence
  Description of Artificial Sequence: Synthetic peptide
  Seed: EFFDETRQL (PIK3CA R88Q)
ETFDETRQI

SEQ ID NO: 16595 - protein, 9 aa, Artificial Sequence
  Description of Artificial Sequence: Synthetic peptide
  Seed: EFFDETRQL (PIK3CA R88Q)
ETFDETRQK

SEQ ID NO: 16596 - protein, 9 aa, Artificial Sequence
  Description of Artificial Sequence: Synthetic peptide
  Seed: EFFDETRQL (PIK3CA R88Q)
ETFDETRQL

SEQ ID NO: 16597 - protein, 9 aa, Artificial Sequence
  Description of Artificial Sequence: Synthetic peptide
  Seed: EFFDETRQL (PIK3CA R88Q)
ETFDETRQM

SEQ ID NO: 16598 - protein, 9 aa, Artificial Sequence
  Description of Artificial Sequence: Synthetic peptide
  Seed: EFFDETRQL (PIK3CA R88Q)
ETFDETRQR

SEQ ID NO: 16599 - protein, 9 aa, Artificial Sequence
  Description of Artificial Sequence: Synthetic peptide
  Seed: EFFDETRQL (PIK3CA R88Q)
ETFDETRQV

SEQ ID NO: 16600 - protein, 9 aa, Artificial Sequence
  Description of Artificial Sequence: Synthetic peptide
  Seed: EFFDETRQL (PIK3CA R88Q)
ETFDETRQW

SEQ ID NO: 16601 - protein, 9 aa, Artificial Sequence
  Description of Artificial Sequence: Synthetic peptide
  Seed: EFFDETRQL (PIK3CA R88Q)
ETFDETRQY

SEQ ID NO: 16602 - protein, 10 aa, Artificial Sequence
  Description of Artificial Sequence: Synthetic peptide
  Seed: EEFFDETRQL (PIK3CA R88Q)
ETFFDETRQW

SEQ ID NO: 16603 - protein, 9 aa, Artificial Sequence
  Description of Artificial Sequence: Synthetic peptide
  Seed: ETRQLCDLR (PIK3CA R88Q)
ETRQLCDLH

SEQ ID NO: 16604 - protein, 9 aa, Artificial Sequence
  Description of Artificial Sequence: Synthetic peptide
  Seed: ETRQLCDLR (PIK3CA R88Q)
ETRQLCDLL

SEQ ID NO: 16605 - protein, 9 aa, Artificial Sequence
  Description of Artificial Sequence: Synthetic peptide
  Seed: ETRQLCDLR (PIK3CA R88Q)
ETRQLCDLM

SEQ ID NO: 16606 - protein, 11 aa, Artificial Sequence
  Description of Artificial Sequence: Synthetic peptide
  Seed: ETRQLCDLRLF (PIK3CA R88Q)
ETRQLCDLRLW

SEQ ID NO: 16607 - protein, 9 aa, Artificial Sequence
  Description of Artificial Sequence: Synthetic peptide
  Seed: ETRQLCDLR (PIK3CA R88Q)
ETRQLCDLY

SEQ ID NO: 16608 - protein, 9 aa, Artificial Sequence
  Description of Artificial Sequence: Synthetic peptide
  Seed: EFFDETRQL (PIK3CA R88Q)
EVFDETRQF

SEQ ID NO: 16609 - protein, 9 aa, Artificial Sequence
  Description of Artificial Sequence: Synthetic peptide
  Seed: EFFDETRQL (PIK3CA R88Q)
EVFDETRQI

SEQ ID NO: 16610 - protein, 9 aa, Artificial Sequence
  Description of Artificial Sequence: Synthetic peptide
  Seed: EFFDETRQL (PIK3CA R88Q)
EVFDETRQK

SEQ ID NO: 16611 - protein, 9 aa, Artificial Sequence
  Description of Artificial Sequence: Synthetic peptide
  Seed: EFFDETRQL (PIK3CA R88Q)
EVFDETRQL

SEQ ID NO: 16612 - protein, 9 aa, Artificial Sequence
  Description of Artificial Sequence: Synthetic peptide
  Seed: EFFDETRQL (PIK3CA R88Q)
EVFDETRQM

SEQ ID NO: 16613 - protein, 9 aa, Artificial Sequence
  Description of Artificial Sequence: Synthetic peptide
  Seed: EFFDETRQL (PIK3CA R88Q)
EVFDETRQR

SEQ ID NO: 16614 - protein, 9 aa, Artificial Sequence
  Description of Artificial Sequence: Synthetic peptide
  Seed: EFFDETRQL (PIK3CA R88Q)
EVFDETRQV

SEQ ID NO: 16615 - protein, 9 aa, Artificial Sequence
  Description of Artificial Sequence: Synthetic peptide
  Seed: EFFDETRQL (PIK3CA R88Q)
EVFDETRQW

SEQ ID NO: 16616 - protein, 9 aa, Artificial Sequence
  Description of Artificial Sequence: Synthetic peptide
  Seed: EFFDETRQL (PIK3CA R88Q)
EVFDETRQY

SEQ ID NO: 16617 - protein, 9 aa, Artificial Sequence
  Description of Artificial Sequence: Synthetic peptide
  Seed: ETRQLCDLR (PIK3CA R88Q)
EVRQLCDLF

SEQ ID NO: 16618 - protein, 9 aa, Artificial Sequence
  Description of Artificial Sequence: Synthetic peptide
  Seed: ETRQLCDLR (PIK3CA R88Q)
EVRQLCDLH

SEQ ID NO: 16619 - protein, 9 aa, Artificial Sequence
  Description of Artificial Sequence: Synthetic peptide
  Seed: ETRQLCDLR (PIK3CA R88Q)
EVRQLCDLL

SEQ ID NO: 16620 - protein, 9 aa, Artificial Sequence
  Description of Artificial Sequence: Synthetic peptide
  Seed: ETRQLCDLR (PIK3CA R88Q)
EVRQLCDLM

SEQ ID NO: 16621 - protein, 11 aa, Artificial Sequence
  Description of Artificial Sequence: Synthetic peptide
  Seed: ETRQLCDLRLF (PIK3CA R88Q)
EVRQLCDLRLW

SEQ ID NO: 16622 - protein, 9 aa, Artificial Sequence
  Description of Artificial Sequence: Synthetic peptide
  Seed: ETRQLCDLR (PIK3CA R88Q)
EVRQLCDLY

SEQ ID NO: 16623 - protein, 9 aa, Artificial Sequence
  Description of Artificial Sequence: Synthetic peptide
  Seed: EFFDETRQL (PIK3CA R88Q)
EWFDETRQI

SEQ ID NO: 16624 - protein, 9 aa, Artificial Sequence
  Description of Artificial Sequence: Synthetic peptide
  Seed: EFFDETRQL (PIK3CA R88Q)
EWFDETRQK

SEQ ID NO: 16625 - protein, 9 aa, Artificial Sequence
  Description of Artificial Sequence: Synthetic peptide
  Seed: EFFDETRQL (PIK3CA R88Q)
EWFDETRQV

SEQ ID NO: 16626 - protein, 9 aa, Artificial Sequence
  Description of Artificial Sequence: Synthetic peptide
  Seed: EFFDETRQL (PIK3CA R88Q)
EWFDETRQW

SEQ ID NO: 16627 - protein, 9 aa, Artificial Sequence
  Description of Artificial Sequence: Synthetic peptide
  Seed: EFFDETRQL (PIK3CA R88Q)
EWFDETRQY

SEQ ID NO: 16628 - protein, 9 aa, Artificial Sequence
  Description of Artificial Sequence: Synthetic peptide
  Seed: ETRQLCDLR (PIK3CA R88Q)
EWRQLCDLK

SEQ ID NO: 16629 - protein, 9 aa, Artificial Sequence
  Description of Artificial Sequence: Synthetic peptide
  Seed: EFFDETRQL (PIK3CA R88Q)
EYFDETRQA

SEQ ID NO: 16630 - protein, 9 aa, Artificial Sequence
  Description of Artificial Sequence: Synthetic peptide
  Seed: EFFDETRQL (PIK3CA R88Q)
EYFDETRQH

SEQ ID NO: 16631 - protein, 9 aa, Artificial Sequence
  Description of Artificial Sequence: Synthetic peptide
  Seed: EFFDETRQL (PIK3CA R88Q)
EYFDETRQK

SEQ ID NO: 16632 - protein, 9 aa, Artificial Sequence
  Description of Artificial Sequence: Synthetic peptide
  Seed: EFFDETRQL (PIK3CA R88Q)
EYFDETRQR

SEQ ID NO: 16633 - protein, 9 aa, Artificial Sequence
  Description of Artificial Sequence: Synthetic peptide
  Seed: EFFDETRQL (PIK3CA R88Q)
EYFDETRQW

SEQ ID NO: 16634 - protein, 9 aa, Artificial Sequence
  Description of Artificial Sequence: Synthetic peptide
  Seed: ETRQLCDLR (PIK3CA R88Q)
EYRQLCDLK

SEQ ID NO: 16635 - protein, 8 aa, Artificial Sequence
  Description of Artificial Sequence: Synthetic peptide
  Seed: FFDETRQL (PIK3CA R88Q)
FADETRQA

SEQ ID NO: 16636 - protein, 8 aa, Artificial Sequence
  Description of Artificial Sequence: Synthetic peptide
  Seed: FFDETRQL (PIK3CA R88Q)
FADETRQC

SEQ ID NO: 16637 - protein, 8 aa, Artificial Sequence
  Description of Artificial Sequence: Synthetic peptide
  Seed: FFDETRQL (PIK3CA R88Q)
FADETRQE

SEQ ID NO: 16638 - protein, 8 aa, Artificial Sequence
  Description of Artificial Sequence: Synthetic peptide
  Seed: FFDETRQL (PIK3CA R88Q)
FADETRQF

SEQ ID NO: 16639 - protein, 8 aa, Artificial Sequence
  Description of Artificial Sequence: Synthetic peptide
  Seed: FFDETRQL (PIK3CA R88Q)
FADETRQH

SEQ ID NO: 16640 - protein, 8 aa, Artificial Sequence
  Description of Artificial Sequence: Synthetic peptide
  Seed: FFDETRQL (PIK3CA R88Q)
FADETRQI

SEQ ID NO: 16641 - protein, 8 aa, Artificial Sequence
  Description of Artificial Sequence: Synthetic peptide
  Seed: FFDETRQL (PIK3CA R88Q)
FADETRQK

SEQ ID NO: 16642 - protein, 9 aa, Artificial Sequence
  Description of Artificial Sequence: Synthetic peptide
  Seed: FFDETRQLC (PIK3CA R88Q)
FADETRQLA

SEQ ID NO: 16643 - protein, 9 aa, Artificial Sequence
  Description of Artificial Sequence: Synthetic peptide
  Seed: FFDETRQLC (PIK3CA R88Q)
FADETRQLC

SEQ ID NO: 16644 - protein, 11 aa, Artificial Sequence
  Description of Artificial Sequence: Synthetic peptide
  Seed: FFDETRQLCDL (PIK3CA R88Q)
FADETRQLCDA

SEQ ID NO: 16645 - protein, 11 aa, Artificial Sequence
  Description of Artificial Sequence: Synthetic peptide
  Seed: FFDETRQLCDL (PIK3CA R88Q)
FADETRQLCDC

SEQ ID NO: 16646 - protein, 11 aa, Artificial Sequence
  Description of Artificial Sequence: Synthetic peptide
  Seed: FFDETRQLCDL (PIK3CA R88Q)
FADETRQLCDF

SEQ ID NO: 16647 - protein, 11 aa, Artificial Sequence
  Description of Artificial Sequence: Synthetic peptide
  Seed: FFDETRQLCDL (PIK3CA R88Q)
FADETRQLCDI

SEQ ID NO: 16648 - protein, 11 aa, Artificial Sequence
  Description of Artificial Sequence: Synthetic peptide
  Seed: FFDETRQLCDL (PIK3CA R88Q)
FADETRQLCDL

SEQ ID NO: 16649 - protein, 11 aa, Artificial Sequence
  Description of Artificial Sequence: Synthetic peptide
  Seed: FFDETRQLCDL (PIK3CA R88Q)
FADETRQLCDM

SEQ ID NO: 16650 - protein, 11 aa, Artificial Sequence
  Description of Artificial Sequence: Synthetic peptide
  Seed: FFDETRQLCDL (PIK3CA R88Q)
FADETRQLCDV

SEQ ID NO: 16651 - protein, 11 aa, Artificial Sequence
  Description of Artificial Sequence: Synthetic peptide
  Seed: FFDETRQLCDL (PIK3CA R88Q)
FADETRQLCDW

SEQ ID NO: 16652 - protein, 11 aa, Artificial Sequence
  Description of Artificial Sequence: Synthetic peptide
  Seed: FFDETRQLCDL (PIK3CA R88Q)
FADETRQLCDY

SEQ ID NO: 16653 - protein, 9 aa, Artificial Sequence
  Description of Artificial Sequence: Synthetic peptide
  Seed: FFDETRQLC (PIK3CA R88Q)
FADETRQLD

SEQ ID NO: 16654 - protein, 9 aa, Artificial Sequence
  Description of Artificial Sequence: Synthetic peptide
  Seed: FFDETRQLC (PIK3CA R88Q)
FADETRQLE

SEQ ID NO: 16655 - protein, 9 aa, Artificial Sequence
  Description of Artificial Sequence: Synthetic peptide
  Seed: FFDETRQLC (PIK3CA R88Q)
FADETRQLF

SEQ ID NO: 16656 - protein, 9 aa, Artificial Sequence
  Description of Artificial Sequence: Synthetic peptide
  Seed: FFDETRQLC (PIK3CA R88Q)
FADETRQLG

SEQ ID NO: 16657 - protein, 9 aa, Artificial Sequence
  Description of Artificial Sequence: Synthetic peptide
  Seed: FFDETRQLC (PIK3CA R88Q)
FADETRQLH

SEQ ID NO: 16658 - protein, 9 aa, Artificial Sequence
  Description of Artificial Sequence: Synthetic peptide
  Seed: FFDETRQLC (PIK3CA R88Q)
FADETRQLI

SEQ ID NO: 16659 - protein, 9 aa, Artificial Sequence
  Description of Artificial Sequence: Synthetic peptide
  Seed: FFDETRQLC (PIK3CA R88Q)
FADETRQLK

SEQ ID NO: 16660 - protein, 9 aa, Artificial Sequence
  Description of Artificial Sequence: Synthetic peptide
  Seed: FFDETRQLC (PIK3CA R88Q)
FADETRQLL

SEQ ID NO: 16661 - protein, 9 aa, Artificial Sequence
  Description of Artificial Sequence: Synthetic peptide
  Seed: FFDETRQLC (PIK3CA R88Q)
FADETRQLM

SEQ ID NO: 16662 - protein, 9 aa, Artificial Sequence
  Description of Artificial Sequence: Synthetic peptide
  Seed: FFDETRQLC (PIK3CA R88Q)
FADETRQLN

SEQ ID NO: 16663 - protein, 9 aa, Artificial Sequence
  Description of Artificial Sequence: Synthetic peptide
  Seed: FFDETRQLC (PIK3CA R88Q)
FADETRQLP

SEQ ID NO: 16664 - protein, 9 aa, Artificial Sequence
  Description of Artificial Sequence: Synthetic peptide
  Seed: FFDETRQLC (PIK3CA R88Q)
FADETRQLQ

SEQ ID NO: 16665 - protein, 9 aa, Artificial Sequence
  Description of Artificial Sequence: Synthetic peptide
  Seed: FFDETRQLC (PIK3CA R88Q)
FADETRQLR

SEQ ID NO: 16666 - protein, 9 aa, Artificial Sequence
  Description of Artificial Sequence: Synthetic peptide
  Seed: FFDETRQLC (PIK3CA R88Q)
FADETRQLS

SEQ ID NO: 16667 - protein, 9 aa, Artificial Sequence
  Description of Artificial Sequence: Synthetic peptide
  Seed: FFDETRQLC (PIK3CA R88Q)
FADETRQLT

SEQ ID NO: 16668 - protein, 9 aa, Artificial Sequence
  Description of Artificial Sequence: Synthetic peptide
  Seed: FFDETRQLC (PIK3CA R88Q)
FADETRQLV

SEQ ID NO: 16669 - protein, 9 aa, Artificial Sequence
  Description of Artificial Sequence: Synthetic peptide
  Seed: FFDETRQLC (PIK3CA R88Q)
FADETRQLW

SEQ ID NO: 16670 - protein, 9 aa, Artificial Sequence
  Description of Artificial Sequence: Synthetic peptide
  Seed: FFDETRQLC (PIK3CA R88Q)
FADETRQLY

SEQ ID NO: 16671 - protein, 8 aa, Artificial Sequence
  Description of Artificial Sequence: Synthetic peptide
  Seed: FFDETRQL (PIK3CA R88Q)
FADETRQM

SEQ ID NO: 16672 - protein, 8 aa, Artificial Sequence
  Description of Artificial Sequence: Synthetic peptide
  Seed: FFDETRQL (PIK3CA R88Q)
FADETRQP

SEQ ID NO: 16673 - protein, 8 aa, Artificial Sequence
  Description of Artificial Sequence: Synthetic peptide
  Seed: FFDETRQL (PIK3CA R88Q)
FADETRQQ

SEQ ID NO: 16674 - protein, 8 aa, Artificial Sequence
  Description of Artificial Sequence: Synthetic peptide
  Seed: FFDETRQL (PIK3CA R88Q)
FADETRQR

SEQ ID NO: 16675 - protein, 8 aa, Artificial Sequence
  Description of Artificial Sequence: Synthetic peptide
  Seed: FFDETRQL (PIK3CA R88Q)
FADETRQS

SEQ ID NO: 16676 - protein, 8 aa, Artificial Sequence
  Description of Artificial Sequence: Synthetic peptide
  Seed: FFDETRQL (PIK3CA R88Q)
FADETRQT

SEQ ID NO: 16677 - protein, 8 aa, Artificial Sequence
  Description of Artificial Sequence: Synthetic peptide
  Seed: FFDETRQL (PIK3CA R88Q)
FADETRQV

SEQ ID NO: 16678 - protein, 8 aa, Artificial Sequence
  Description of Artificial Sequence: Synthetic peptide
  Seed: FFDETRQL (PIK3CA R88Q)
FADETRQW

SEQ ID NO: 16679 - protein, 8 aa, Artificial Sequence
  Description of Artificial Sequence: Synthetic peptide
  Seed: FFDETRQL (PIK3CA R88Q)
FADETRQY

SEQ ID NO: 16680 - protein, 8 aa, Artificial Sequence
  Description of Artificial Sequence: Synthetic peptide
  Seed: FFDETRQL (PIK3CA R88Q)
FCDETRQA

SEQ ID NO: 16681 - protein, 8 aa, Artificial Sequence
  Description of Artificial Sequence: Synthetic peptide
  Seed: FFDETRQL (PIK3CA R88Q)
FCDETRQC

SEQ ID NO: 16682 - protein, 8 aa, Artificial Sequence
  Description of Artificial Sequence: Synthetic peptide
  Seed: FFDETRQL (PIK3CA R88Q)
FCDETRQF

SEQ ID NO: 16683 - protein, 8 aa, Artificial Sequence
  Description of Artificial Sequence: Synthetic peptide
  Seed: FFDETRQL (PIK3CA R88Q)
FCDETRQI

SEQ ID NO: 16684 - protein, 8 aa, Artificial Sequence
  Description of Artificial Sequence: Synthetic peptide
  Seed: FFDETRQL (PIK3CA R88Q)
FCDETRQL

SEQ ID NO: 16685 - protein, 9 aa, Artificial Sequence
  Description of Artificial Sequence: Synthetic peptide
  Seed: FFDETRQLC (PIK3CA R88Q)
FCDETRQLA

SEQ ID NO: 16686 - protein, 9 aa, Artificial Sequence
  Description of Artificial Sequence: Synthetic peptide
  Seed: FFDETRQLC (PIK3CA R88Q)
FCDETRQLC

SEQ ID NO: 16687 - protein, 11 aa, Artificial Sequence
  Description of Artificial Sequence: Synthetic peptide
  Seed: FFDETRQLCDL (PIK3CA R88Q)
FCDETRQLCDF

SEQ ID NO: 16688 - protein, 11 aa, Artificial Sequence
  Description of Artificial Sequence: Synthetic peptide
  Seed: FFDETRQLCDL (PIK3CA R88Q)
FCDETRQLCDI

SEQ ID NO: 16689 - protein, 11 aa, Artificial Sequence
  Description of Artificial Sequence: Synthetic peptide
  Seed: FFDETRQLCDL (PIK3CA R88Q)
FCDETRQLCDL

SEQ ID NO: 16690 - protein, 11 aa, Artificial Sequence
  Description of Artificial Sequence: Synthetic peptide
  Seed: FFDETRQLCDL (PIK3CA R88Q)
FCDETRQLCDM

SEQ ID NO: 16691 - protein, 11 aa, Artificial Sequence
  Description of Artificial Sequence: Synthetic peptide
  Seed: FFDETRQLCDL (PIK3CA R88Q)
FCDETRQLCDV

SEQ ID NO: 16692 - protein, 9 aa, Artificial Sequence
  Description of Artificial Sequence: Synthetic peptide
  Seed: FFDETRQLC (PIK3CA R88Q)
FCDETRQLF

SEQ ID NO: 16693 - protein, 9 aa, Artificial Sequence
  Description of Artificial Sequence: Synthetic peptide
  Seed: FFDETRQLC (PIK3CA R88Q)
FCDETRQLI

SEQ ID NO: 16694 - protein, 9 aa, Artificial Sequence
  Description of Artificial Sequence: Synthetic peptide
  Seed: FFDETRQLC (PIK3CA R88Q)
FCDETRQLK

SEQ ID NO: 16695 - protein, 9 aa, Artificial Sequence
  Description of Artificial Sequence: Synthetic peptide
  Seed: FFDETRQLC (PIK3CA R88Q)
FCDETRQLL

SEQ ID NO: 16696 - protein, 9 aa, Artificial Sequence
  Description of Artificial Sequence: Synthetic peptide
  Seed: FFDETRQLC (PIK3CA R88Q)
FCDETRQLM

SEQ ID NO: 16697 - protein, 9 aa, Artificial Sequence
  Description of Artificial Sequence: Synthetic peptide
  Seed: FFDETRQLC (PIK3CA R88Q)
FCDETRQLR

SEQ ID NO: 16698 - protein, 9 aa, Artificial Sequence
  Description of Artificial Sequence: Synthetic peptide
  Seed: FFDETRQLC (PIK3CA R88Q)
FCDETRQLT

SEQ ID NO: 16699 - protein, 9 aa, Artificial Sequence
  Description of Artificial Sequence: Synthetic peptide
  Seed: FFDETRQLC (PIK3CA R88Q)
FCDETRQLV

SEQ ID NO: 16700 - protein, 9 aa, Artificial Sequence
  Description of Artificial Sequence: Synthetic peptide
  Seed: FFDETRQLC (PIK3CA R88Q)
FCDETRQLW

SEQ ID NO: 16701 - protein, 9 aa, Artificial Sequence
  Description of Artificial Sequence: Synthetic peptide
  Seed: FFDETRQLC (PIK3CA R88Q)
FCDETRQLY

SEQ ID NO: 16702 - protein, 8 aa, Artificial Sequence
  Description of Artificial Sequence: Synthetic peptide
  Seed: FFDETRQL (PIK3CA R88Q)
FCDETRQM

SEQ ID NO: 16703 - protein, 8 aa, Artificial Sequence
  Description of Artificial Sequence: Synthetic peptide
  Seed: FFDETRQL (PIK3CA R88Q)
FCDETRQV

SEQ ID NO: 16704 - protein, 8 aa, Artificial Sequence
  Description of Artificial Sequence: Synthetic peptide
  Seed: FFDETRQL (PIK3CA R88Q)
FCDETRQW

SEQ ID NO: 16705 - protein, 8 aa, Artificial Sequence
  Description of Artificial Sequence: Synthetic peptide
  Seed: FFDETRQL (PIK3CA R88Q)
FCDETRQY

SEQ ID NO: 16706 - protein, 8 aa, Artificial Sequence
  Description of Artificial Sequence: Synthetic peptide
  Seed: FFDETRQL (PIK3CA R88Q)
FDDETRQF

SEQ ID NO: 16707 - protein, 8 aa, Artificial Sequence
  Description of Artificial Sequence: Synthetic peptide
  Seed: FFDETRQL (PIK3CA R88Q)
FDDETRQI

SEQ ID NO: 16708 - protein, 8 aa, Artificial Sequence
  Description of Artificial Sequence: Synthetic peptide
  Seed: FFDETRQL (PIK3CA R88Q)
FDDETRQL

SEQ ID NO: 16709 - protein, 9 aa, Artificial Sequence
  Description of Artificial Sequence: Synthetic peptide
  Seed: FFDETRQLC (PIK3CA R88Q)
FDDETRQLA

SEQ ID NO: 16710 - protein, 9 aa, Artificial Sequence
  Description of Artificial Sequence: Synthetic peptide
  Seed: FFDETRQLC (PIK3CA R88Q)
FDDETRQLC

SEQ ID NO: 16711 - protein, 11 aa, Artificial Sequence
  Description of Artificial Sequence: Synthetic peptide
  Seed: FFDETRQLCDL (PIK3CA R88Q)
FDDETRQLCDL

SEQ ID NO: 16712 - protein, 11 aa, Artificial Sequence
  Description of Artificial Sequence: Synthetic peptide
  Seed: FFDETRQLCDL (PIK3CA R88Q)
FDDETRQLCDM

SEQ ID NO: 16713 - protein, 9 aa, Artificial Sequence
  Description of Artificial Sequence: Synthetic peptide
  Seed: FFDETRQLC (PIK3CA R88Q)
FDDETRQLF

SEQ ID NO: 16714 - protein, 9 aa, Artificial Sequence
  Description of Artificial Sequence: Synthetic peptide
  Seed: FFDETRQLC (PIK3CA R88Q)
FDDETRQLI

SEQ ID NO: 16715 - protein, 9 aa, Artificial Sequence
  Description of Artificial Sequence: Synthetic peptide
  Seed: FFDETRQLC (PIK3CA R88Q)
FDDETRQLK

SEQ ID NO: 16716 - protein, 9 aa, Artificial Sequence
  Description of Artificial Sequence: Synthetic peptide
  Seed: FFDETRQLC (PIK3CA R88Q)
FDDETRQLL

SEQ ID NO: 16717 - protein, 9 aa, Artificial Sequence
  Description of Artificial Sequence: Synthetic peptide
  Seed: FFDETRQLC (PIK3CA R88Q)
FDDETRQLM

SEQ ID NO: 16718 - protein, 9 aa, Artificial Sequence
  Description of Artificial Sequence: Synthetic peptide
  Seed: FFDETRQLC (PIK3CA R88Q)
FDDETRQLR

SEQ ID NO: 16719 - protein, 9 aa, Artificial Sequence
  Description of Artificial Sequence: Synthetic peptide
  Seed: FFDETRQLC (PIK3CA R88Q)
FDDETRQLV

SEQ ID NO: 16720 - protein, 9 aa, Artificial Sequence
  Description of Artificial Sequence: Synthetic peptide
  Seed: FFDETRQLC (PIK3CA R88Q)
FDDETRQLW

SEQ ID NO: 16721 - protein, 9 aa, Artificial Sequence
  Description of Artificial Sequence: Synthetic peptide
  Seed: FFDETRQLC (PIK3CA R88Q)
FDDETRQLY

SEQ ID NO: 16722 - protein, 8 aa, Artificial Sequence
  Description of Artificial Sequence: Synthetic peptide
  Seed: FFDETRQL (PIK3CA R88Q)
FDDETRQM

SEQ ID NO: 16723 - protein, 8 aa, Artificial Sequence
  Description of Artificial Sequence: Synthetic peptide
  Seed: FFDETRQL (PIK3CA R88Q)
FDDETRQV

SEQ ID NO: 16724 - protein, 8 aa, Artificial Sequence
  Description of Artificial Sequence: Synthetic peptide
  Seed: FFDETRQL (PIK3CA R88Q)
FDDETRQW

SEQ ID NO: 16725 - protein, 8 aa, Artificial Sequence
  Description of Artificial Sequence: Synthetic peptide
  Seed: FFDETRQL (PIK3CA R88Q)
FDDETRQY

SEQ ID NO: 16726 - protein, 8 aa, Artificial Sequence
  Description of Artificial Sequence: Synthetic peptide
  Seed: FFDETRQL (PIK3CA R88Q)
FEDETRQF

SEQ ID NO: 16727 - protein, 8 aa, Artificial Sequence
  Description of Artificial Sequence: Synthetic peptide
  Seed: FFDETRQL (PIK3CA R88Q)
FEDETRQI

SEQ ID NO: 16728 - protein, 8 aa, Artificial Sequence
  Description of Artificial Sequence: Synthetic peptide
  Seed: FFDETRQL (PIK3CA R88Q)
FEDETRQL

SEQ ID NO: 16729 - protein, 9 aa, Artificial Sequence
  Description of Artificial Sequence: Synthetic peptide
  Seed: FFDETRQLC (PIK3CA R88Q)
FEDETRQLA

SEQ ID NO: 16730 - protein, 9 aa, Artificial Sequence
  Description of Artificial Sequence: Synthetic peptide
  Seed: FFDETRQLC (PIK3CA R88Q)
FEDETRQLC

SEQ ID NO: 16731 - protein, 11 aa, Artificial Sequence
  Description of Artificial Sequence: Synthetic peptide
  Seed: FFDETRQLCDL (PIK3CA R88Q)
FEDETRQLCDF

SEQ ID NO: 16732 - protein, 11 aa, Artificial Sequence
  Description of Artificial Sequence: Synthetic peptide
  Seed: FFDETRQLCDL (PIK3CA R88Q)
FEDETRQLCDL

SEQ ID NO: 16733 - protein, 11 aa, Artificial Sequence
  Description of Artificial Sequence: Synthetic peptide
  Seed: FFDETRQLCDL (PIK3CA R88Q)
FEDETRQLCDM

SEQ ID NO: 16734 - protein, 9 aa, Artificial Sequence
  Description of Artificial Sequence: Synthetic peptide
  Seed: FFDETRQLC (PIK3CA R88Q)
FEDETRQLF

SEQ ID NO: 16735 - protein, 9 aa, Artificial Sequence
  Description of Artificial Sequence: Synthetic peptide
  Seed: FFDETRQLC (PIK3CA R88Q)
FEDETRQLI

SEQ ID NO: 16736 - protein, 9 aa, Artificial Sequence
  Description of Artificial Sequence: Synthetic peptide
  Seed: FFDETRQLC (PIK3CA R88Q)
FEDETRQLK

SEQ ID NO: 16737 - protein, 9 aa, Artificial Sequence
  Description of Artificial Sequence: Synthetic peptide
  Seed: FFDETRQLC (PIK3CA R88Q)
FEDETRQLL

SEQ ID NO: 16738 - protein, 9 aa, Artificial Sequence
  Description of Artificial Sequence: Synthetic peptide
  Seed: FFDETRQLC (PIK3CA R88Q)
FEDETRQLM

SEQ ID NO: 16739 - protein, 9 aa, Artificial Sequence
  Description of Artificial Sequence: Synthetic peptide
  Seed: FFDETRQLC (PIK3CA R88Q)
FEDETRQLR

SEQ ID NO: 16740 - protein, 9 aa, Artificial Sequence
  Description of Artificial Sequence: Synthetic peptide
  Seed: FFDETRQLC (PIK3CA R88Q)
FEDETRQLV

SEQ ID NO: 16741 - protein, 9 aa, Artificial Sequence
  Description of Artificial Sequence: Synthetic peptide
  Seed: FFDETRQLC (PIK3CA R88Q)
FEDETRQLW

SEQ ID NO: 16742 - protein, 9 aa, Artificial Sequence
  Description of Artificial Sequence: Synthetic peptide
  Seed: FFDETRQLC (PIK3CA R88Q)
FEDETRQLY

SEQ ID NO: 16743 - protein, 8 aa, Artificial Sequence
  Description of Artificial Sequence: Synthetic peptide
  Seed: FFDETRQL (PIK3CA R88Q)
FEDETRQM

SEQ ID NO: 16744 - protein, 8 aa, Artificial Sequence
  Description of Artificial Sequence: Synthetic peptide
  Seed: FFDETRQL (PIK3CA R88Q)
FEDETRQV

SEQ ID NO: 16745 - protein, 8 aa, Artificial Sequence
  Description of Artificial Sequence: Synthetic peptide
  Seed: FFDETRQL (PIK3CA R88Q)
FEDETRQW

SEQ ID NO: 16746 - protein, 8 aa, Artificial Sequence
  Description of Artificial Sequence: Synthetic peptide
  Seed: FFDETRQL (PIK3CA R88Q)
FEDETRQY

SEQ ID NO: 16747 - protein, 8 aa, Artificial Sequence
  Description of Artificial Sequence: Synthetic peptide
  Seed: FFDETRQL (PIK3CA R88Q)
FFDETRQA

SEQ ID NO: 16748 - protein, 8 aa, Artificial Sequence
  Description of Artificial Sequence: Synthetic peptide
  Seed: FFDETRQL (PIK3CA R88Q)
FFDETRQC

SEQ ID NO: 16749 - protein, 8 aa, Artificial Sequence
  Description of Artificial Sequence: Synthetic peptide
  Seed: FFDETRQL (PIK3CA R88Q)
FFDETRQH

SEQ ID NO: 16750 - protein, 8 aa, Artificial Sequence
  Description of Artificial Sequence: Synthetic peptide
  Seed: FFDETRQL (PIK3CA R88Q)
FFDETRQI

SEQ ID NO: 16751 - protein, 8 aa, Artificial Sequence
  Description of Artificial Sequence: Synthetic peptide
  Seed: FFDETRQL (PIK3CA R88Q)
FFDETRQK

SEQ ID NO: 16752 - protein, 9 aa, Artificial Sequence
  Description of Artificial Sequence: Synthetic peptide
  Seed: FFDETRQLC (PIK3CA R88Q)
FFDETRQLA

SEQ ID NO: 16753 - protein, 11 aa, Artificial Sequence
  Description of Artificial Sequence: Synthetic peptide
  Seed: FFDETRQLCDL (PIK3CA R88Q)
FFDETRQLCDC

SEQ ID NO: 16754 - protein, 11 aa, Artificial Sequence
  Description of Artificial Sequence: Synthetic peptide
  Seed: FFDETRQLCDL (PIK3CA R88Q)
FFDETRQLCDF

SEQ ID NO: 16755 - protein, 11 aa, Artificial Sequence
  Description of Artificial Sequence: Synthetic peptide
  Seed: FFDETRQLCDL (PIK3CA R88Q)
FFDETRQLCDI

SEQ ID NO: 16756 - protein, 11 aa, Artificial Sequence
  Description of Artificial Sequence: Synthetic peptide
  Seed: FFDETRQLCDL (PIK3CA R88Q)
FFDETRQLCDM

SEQ ID NO: 16757 - protein, 11 aa, Artificial Sequence
  Description of Artificial Sequence: Synthetic peptide
  Seed: FFDETRQLCDL (PIK3CA R88Q)
FFDETRQLCDV

SEQ ID NO: 16758 - protein, 11 aa, Artificial Sequence
  Description of Artificial Sequence: Synthetic peptide
  Seed: FFDETRQLCDL (PIK3CA R88Q)
FFDETRQLCDW

SEQ ID NO: 16759 - protein, 11 aa, Artificial Sequence
  Description of Artificial Sequence: Synthetic peptide
  Seed: FFDETRQLCDL (PIK3CA R88Q)
FFDETRQLCDY

SEQ ID NO: 16760 - protein, 9 aa, Artificial Sequence
  Description of Artificial Sequence: Synthetic peptide
  Seed: FFDETRQLC (PIK3CA R88Q)
FFDETRQLD

SEQ ID NO: 16761 - protein, 9 aa, Artificial Sequence
  Description of Artificial Sequence: Synthetic peptide
  Seed: FFDETRQLC (PIK3CA R88Q)
FFDETRQLE

SEQ ID NO: 16762 - protein, 9 aa, Artificial Sequence
  Description of Artificial Sequence: Synthetic peptide
  Seed: FFDETRQLC (PIK3CA R88Q)
FFDETRQLF

SEQ ID NO: 16763 - protein, 9 aa, Artificial Sequence
  Description of Artificial Sequence: Synthetic peptide
  Seed: FFDETRQLC (PIK3CA R88Q)
FFDETRQLG

SEQ ID NO: 16764 - protein, 9 aa, Artificial Sequence
  Description of Artificial Sequence: Synthetic peptide
  Seed: FFDETRQLC (PIK3CA R88Q)
FFDETRQLH

SEQ ID NO: 16765 - protein, 9 aa, Artificial Sequence
  Description of Artificial Sequence: Synthetic peptide
  Seed: FFDETRQLC (PIK3CA R88Q)
FFDETRQLI

SEQ ID NO: 16766 - protein, 9 aa, Artificial Sequence
  Description of Artificial Sequence: Synthetic peptide
  Seed: FFDETRQLC (PIK3CA R88Q)
FFDETRQLK

SEQ ID NO: 16767 - protein, 9 aa, Artificial Sequence
  Description of Artificial Sequence: Synthetic peptide
  Seed: FFDETRQLC (PIK3CA R88Q)
FFDETRQLN

SEQ ID NO: 16768 - protein, 9 aa, Artificial Sequence
  Description of Artificial Sequence: Synthetic peptide
  Seed: FFDETRQLC (PIK3CA R88Q)
FFDETRQLP

SEQ ID NO: 16769 - protein, 9 aa, Artificial Sequence
  Description of Artificial Sequence: Synthetic peptide
  Seed: FFDETRQLC (PIK3CA R88Q)
FFDETRQLQ

SEQ ID NO: 16770 - protein, 9 aa, Artificial Sequence
  Description of Artificial Sequence: Synthetic peptide
  Seed: FFDETRQLC (PIK3CA R88Q)
FFDETRQLR

SEQ ID NO: 16771 - protein, 9 aa, Artificial Sequence
  Description of Artificial Sequence: Synthetic peptide
  Seed: FFDETRQLC (PIK3CA R88Q)
FFDETRQLS

SEQ ID NO: 16772 - protein, 9 aa, Artificial Sequence
  Description of Artificial Sequence: Synthetic peptide
  Seed: FFDETRQLC (PIK3CA R88Q)
FFDETRQLT

SEQ ID NO: 16773 - protein, 9 aa, Artificial Sequence
  Description of Artificial Sequence: Synthetic peptide
  Seed: FFDETRQLC (PIK3CA R88Q)
FFDETRQLV

SEQ ID NO: 16774 - protein, 9 aa, Artificial Sequence
  Description of Artificial Sequence: Synthetic peptide
  Seed: FFDETRQLC (PIK3CA R88Q)
FFDETRQLW

SEQ ID NO: 16775 - protein, 9 aa, Artificial Sequence
  Description of Artificial Sequence: Synthetic peptide
  Seed: FFDETRQLC (PIK3CA R88Q)
FFDETRQLY

SEQ ID NO: 16776 - protein, 8 aa, Artificial Sequence
  Description of Artificial Sequence: Synthetic peptide
  Seed: FFDETRQL (PIK3CA R88Q)
FFDETRQQ

SEQ ID NO: 16777 - protein, 8 aa, Artificial Sequence
  Description of Artificial Sequence: Synthetic peptide
  Seed: FFDETRQL (PIK3CA R88Q)
FFDETRQR

SEQ ID NO: 16778 - protein, 8 aa, Artificial Sequence
  Description of Artificial Sequence: Synthetic peptide
  Seed: FFDETRQL (PIK3CA R88Q)
FFDETRQS

SEQ ID NO: 16779 - protein, 8 aa, Artificial Sequence
  Description of Artificial Sequence: Synthetic peptide
  Seed: FFDETRQL (PIK3CA R88Q)
FFDETRQT

SEQ ID NO: 16780 - protein, 8 aa, Artificial Sequence
  Description of Artificial Sequence: Synthetic peptide
  Seed: FFDETRQL (PIK3CA R88Q)
FFDETRQV

SEQ ID NO: 16781 - protein, 8 aa, Artificial Sequence
  Description of Artificial Sequence: Synthetic peptide
  Seed: FFDETRQL (PIK3CA R88Q)
FFDETRQW

SEQ ID NO: 16782 - protein, 8 aa, Artificial Sequence
  Description of Artificial Sequence: Synthetic peptide
  Seed: FFDETRQL (PIK3CA R88Q)
FGDETRQA

SEQ ID NO: 16783 - protein, 8 aa, Artificial Sequence
  Description of Artificial Sequence: Synthetic peptide
  Seed: FFDETRQL (PIK3CA R88Q)
FGDETRQC

SEQ ID NO: 16784 - protein, 8 aa, Artificial Sequence
  Description of Artificial Sequence: Synthetic peptide
  Seed: FFDETRQL (PIK3CA R88Q)
FGDETRQF

SEQ ID NO: 16785 - protein, 8 aa, Artificial Sequence
  Description of Artificial Sequence: Synthetic peptide
  Seed: FFDETRQL (PIK3CA R88Q)
FGDETRQI

SEQ ID NO: 16786 - protein, 8 aa, Artificial Sequence
  Description of Artificial Sequence: Synthetic peptide
  Seed: FFDETRQL (PIK3CA R88Q)
FGDETRQK

SEQ ID NO: 16787 - protein, 8 aa, Artificial Sequence
  Description of Artificial Sequence: Synthetic peptide
  Seed: FFDETRQL (PIK3CA R88Q)
FGDETRQL

SEQ ID NO: 16788 - protein, 9 aa, Artificial Sequence
  Description of Artificial Sequence: Synthetic peptide
  Seed: FFDETRQLC (PIK3CA R88Q)
FGDETRQLA

SEQ ID NO: 16789 - protein, 9 aa, Artificial Sequence
  Description of Artificial Sequence: Synthetic peptide
  Seed: FFDETRQLC (PIK3CA R88Q)
FGDETRQLC

SEQ ID NO: 16790 - protein, 11 aa, Artificial Sequence
  Description of Artificial Sequence: Synthetic peptide
  Seed: FFDETRQLCDL (PIK3CA R88Q)
FGDETRQLCDC

SEQ ID NO: 16791 - protein, 11 aa, Artificial Sequence
  Description of Artificial Sequence: Synthetic peptide
  Seed: FFDETRQLCDL (PIK3CA R88Q)
FGDETRQLCDF

SEQ ID NO: 16792 - protein, 11 aa, Artificial Sequence
  Description of Artificial Sequence: Synthetic peptide
  Seed: FFDETRQLCDL (PIK3CA R88Q)
FGDETRQLCDI

SEQ ID NO: 16793 - protein, 11 aa, Artificial Sequence
  Description of Artificial Sequence: Synthetic peptide
  Seed: FFDETRQLCDL (PIK3CA R88Q)
FGDETRQLCDL

SEQ ID NO: 16794 - protein, 11 aa, Artificial Sequence
  Description of Artificial Sequence: Synthetic peptide
  Seed: FFDETRQLCDL (PIK3CA R88Q)
FGDETRQLCDM

SEQ ID NO: 16795 - protein, 11 aa, Artificial Sequence
  Description of Artificial Sequence: Synthetic peptide
  Seed: FFDETRQLCDL (PIK3CA R88Q)
FGDETRQLCDV

SEQ ID NO: 16796 - protein, 11 aa, Artificial Sequence
  Description of Artificial Sequence: Synthetic peptide
  Seed: FFDETRQLCDL (PIK3CA R88Q)
FGDETRQLCDW

SEQ ID NO: 16797 - protein, 11 aa, Artificial Sequence
  Description of Artificial Sequence: Synthetic peptide
  Seed: FFDETRQLCDL (PIK3CA R88Q)
FGDETRQLCDY

SEQ ID NO: 16798 - protein, 9 aa, Artificial Sequence
  Description of Artificial Sequence: Synthetic peptide
  Seed: FFDETRQLC (PIK3CA R88Q)
FGDETRQLF

SEQ ID NO: 16799 - protein, 9 aa, Artificial Sequence
  Description of Artificial Sequence: Synthetic peptide
  Seed: FFDETRQLC (PIK3CA R88Q)
FGDETRQLH

SEQ ID NO: 16800 - protein, 9 aa, Artificial Sequence
  Description of Artificial Sequence: Synthetic peptide
  Seed: FFDETRQLC (PIK3CA R88Q)
FGDETRQLI

SEQ ID NO: 16801 - protein, 9 aa, Artificial Sequence
  Description of Artificial Sequence: Synthetic peptide
  Seed: FFDETRQLC (PIK3CA R88Q)
FGDETRQLK

SEQ ID NO: 16802 - protein, 9 aa, Artificial Sequence
  Description of Artificial Sequence: Synthetic peptide
  Seed: FFDETRQLC (PIK3CA R88Q)
FGDETRQLL

SEQ ID NO: 16803 - protein, 9 aa, Artificial Sequence
  Description of Artificial Sequence: Synthetic peptide
  Seed: FFDETRQLC (PIK3CA R88Q)
FGDETRQLM

SEQ ID NO: 16804 - protein, 9 aa, Artificial Sequence
  Description of Artificial Sequence: Synthetic peptide
  Seed: FFDETRQLC (PIK3CA R88Q)
FGDETRQLP

SEQ ID NO: 16805 - protein, 9 aa, Artificial Sequence
  Description of Artificial Sequence: Synthetic peptide
  Seed: FFDETRQLC (PIK3CA R88Q)
FGDETRQLQ

SEQ ID NO: 16806 - protein, 9 aa, Artificial Sequence
  Description of Artificial Sequence: Synthetic peptide
  Seed: FFDETRQLC (PIK3CA R88Q)
FGDETRQLR

SEQ ID NO: 16807 - protein, 9 aa, Artificial Sequence
  Description of Artificial Sequence: Synthetic peptide
  Seed: FFDETRQLC (PIK3CA R88Q)
FGDETRQLS

SEQ ID NO: 16808 - protein, 9 aa, Artificial Sequence
  Description of Artificial Sequence: Synthetic peptide
  Seed: FFDETRQLC (PIK3CA R88Q)
FGDETRQLT

SEQ ID NO: 16809 - protein, 9 aa, Artificial Sequence
  Description of Artificial Sequence: Synthetic peptide
  Seed: FFDETRQLC (PIK3CA R88Q)
FGDETRQLV

SEQ ID NO: 16810 - protein, 9 aa, Artificial Sequence
  Description of Artificial Sequence: Synthetic peptide
  Seed: FFDETRQLC (PIK3CA R88Q)
FGDETRQLW

SEQ ID NO: 16811 - protein, 9 aa, Artificial Sequence
  Description of Artificial Sequence: Synthetic peptide
  Seed: FFDETRQLC (PIK3CA R88Q)
FGDETRQLY

SEQ ID NO: 16812 - protein, 8 aa, Artificial Sequence
  Description of Artificial Sequence: Synthetic peptide
  Seed: FFDETRQL (PIK3CA R88Q)
FGDETRQM

SEQ ID NO: 16813 - protein, 8 aa, Artificial Sequence
  Description of Artificial Sequence: Synthetic peptide
  Seed: FFDETRQL (PIK3CA R88Q)
FGDETRQR

SEQ ID NO: 16814 - protein, 8 aa, Artificial Sequence
  Description of Artificial Sequence: Synthetic peptide
  Seed: FFDETRQL (PIK3CA R88Q)
FGDETRQT

SEQ ID NO: 16815 - protein, 8 aa, Artificial Sequence
  Description of Artificial Sequence: Synthetic peptide
  Seed: FFDETRQL (PIK3CA R88Q)
FGDETRQV

SEQ ID NO: 16816 - protein, 8 aa, Artificial Sequence
  Description of Artificial Sequence: Synthetic peptide
  Seed: FFDETRQL (PIK3CA R88Q)
FGDETRQW

SEQ ID NO: 16817 - protein, 8 aa, Artificial Sequence
  Description of Artificial Sequence: Synthetic peptide
  Seed: FFDETRQL (PIK3CA R88Q)
FGDETRQY

SEQ ID NO: 16818 - protein, 8 aa, Artificial Sequence
  Description of Artificial Sequence: Synthetic peptide
  Seed: FFDETRQL (PIK3CA R88Q)
FHDETRQF

SEQ ID NO: 16819 - protein, 8 aa, Artificial Sequence
  Description of Artificial Sequence: Synthetic peptide
  Seed: FFDETRQL (PIK3CA R88Q)
FHDETRQI

SEQ ID NO: 16820 - protein, 8 aa, Artificial Sequence
  Description of Artificial Sequence: Synthetic peptide
  Seed: FFDETRQL (PIK3CA R88Q)
FHDETRQL

SEQ ID NO: 16821 - protein, 9 aa, Artificial Sequence
  Description of Artificial Sequence: Synthetic peptide
  Seed: FFDETRQLC (PIK3CA R88Q)
FHDETRQLA

SEQ ID NO: 16822 - protein, 9 aa, Artificial Sequence
  Description of Artificial Sequence: Synthetic peptide
  Seed: FFDETRQLC (PIK3CA R88Q)
FHDETRQLC

SEQ ID NO: 16823 - protein, 11 aa, Artificial Sequence
  Description of Artificial Sequence: Synthetic peptide
  Seed: FFDETRQLCDL (PIK3CA R88Q)
FHDETRQLCDF

SEQ ID NO: 16824 - protein, 11 aa, Artificial Sequence
  Description of Artificial Sequence: Synthetic peptide
  Seed: FFDETRQLCDL (PIK3CA R88Q)
FHDETRQLCDL

SEQ ID NO: 16825 - protein, 11 aa, Artificial Sequence
  Description of Artificial Sequence: Synthetic peptide
  Seed: FFDETRQLCDL (PIK3CA R88Q)
FHDETRQLCDM

SEQ ID NO: 16826 - protein, 9 aa, Artificial Sequence
  Description of Artificial Sequence: Synthetic peptide
  Seed: FFDETRQLC (PIK3CA R88Q)
FHDETRQLF

SEQ ID NO: 16827 - protein, 9 aa, Artificial Sequence
  Description of Artificial Sequence: Synthetic peptide
  Seed: FFDETRQLC (PIK3CA R88Q)
FHDETRQLH

SEQ ID NO: 16828 - protein, 9 aa, Artificial Sequence
  Description of Artificial Sequence: Synthetic peptide
  Seed: FFDETRQLC (PIK3CA R88Q)
FHDETRQLI

SEQ ID NO: 16829 - protein, 9 aa, Artificial Sequence
  Description of Artificial Sequence: Synthetic peptide
  Seed: FFDETRQLC (PIK3CA R88Q)
FHDETRQLK

SEQ ID NO: 16830 - protein, 9 aa, Artificial Sequence
  Description of Artificial Sequence: Synthetic peptide
  Seed: FFDETRQLC (PIK3CA R88Q)
FHDETRQLL

SEQ ID NO: 16831 - protein, 9 aa, Artificial Sequence
  Description of Artificial Sequence: Synthetic peptide
  Seed: FFDETRQLC (PIK3CA R88Q)
FHDETRQLM

SEQ ID NO: 16832 - protein, 9 aa, Artificial Sequence
  Description of Artificial Sequence: Synthetic peptide
  Seed: FFDETRQLC (PIK3CA R88Q)
FHDETRQLR

SEQ ID NO: 16833 - protein, 9 aa, Artificial Sequence
  Description of Artificial Sequence: Synthetic peptide
  Seed: FFDETRQLC (PIK3CA R88Q)
FHDETRQLT

SEQ ID NO: 16834 - protein, 9 aa, Artificial Sequence
  Description of Artificial Sequence: Synthetic peptide
  Seed: FFDETRQLC (PIK3CA R88Q)
FHDETRQLV

SEQ ID NO: 16835 - protein, 9 aa, Artificial Sequence
  Description of Artificial Sequence: Synthetic peptide
  Seed: FFDETRQLC (PIK3CA R88Q)
FHDETRQLW

SEQ ID NO: 16836 - protein, 9 aa, Artificial Sequence
  Description of Artificial Sequence: Synthetic peptide
  Seed: FFDETRQLC (PIK3CA R88Q)
FHDETRQLY

SEQ ID NO: 16837 - protein, 8 aa, Artificial Sequence
  Description of Artificial Sequence: Synthetic peptide
  Seed: FFDETRQL (PIK3CA R88Q)
FHDETRQM

SEQ ID NO: 16838 - protein, 8 aa, Artificial Sequence
  Description of Artificial Sequence: Synthetic peptide
  Seed: FFDETRQL (PIK3CA R88Q)
FHDETRQV

SEQ ID NO: 16839 - protein, 8 aa, Artificial Sequence
  Description of Artificial Sequence: Synthetic peptide
  Seed: FFDETRQL (PIK3CA R88Q)
FHDETRQW

SEQ ID NO: 16840 - protein, 8 aa, Artificial Sequence
  Description of Artificial Sequence: Synthetic peptide
  Seed: FFDETRQL (PIK3CA R88Q)
FHDETRQY

SEQ ID NO: 16841 - protein, 8 aa, Artificial Sequence
  Description of Artificial Sequence: Synthetic peptide
  Seed: FFDETRQL (PIK3CA R88Q)
FIDETRQA

SEQ ID NO: 16842 - protein, 8 aa, Artificial Sequence
  Description of Artificial Sequence: Synthetic peptide
  Seed: FFDETRQL (PIK3CA R88Q)
FIDETRQC

SEQ ID NO: 16843 - protein, 8 aa, Artificial Sequence
  Description of Artificial Sequence: Synthetic peptide
  Seed: FFDETRQL (PIK3CA R88Q)
FIDETRQF

SEQ ID NO: 16844 - protein, 8 aa, Artificial Sequence
  Description of Artificial Sequence: Synthetic peptide
  Seed: FFDETRQL (PIK3CA R88Q)
FIDETRQI

SEQ ID NO: 16845 - protein, 8 aa, Artificial Sequence
  Description of Artificial Sequence: Synthetic peptide
  Seed: FFDETRQL (PIK3CA R88Q)
FIDETRQK

SEQ ID NO: 16846 - protein, 8 aa, Artificial Sequence
  Description of Artificial Sequence: Synthetic peptide
  Seed: FFDETRQL (PIK3CA R88Q)
FIDETRQL

SEQ ID NO: 16847 - protein, 9 aa, Artificial Sequence
  Description of Artificial Sequence: Synthetic peptide
  Seed: FFDETRQLC (PIK3CA R88Q)
FIDETRQLA

SEQ ID NO: 16848 - protein, 9 aa, Artificial Sequence
  Description of Artificial Sequence: Synthetic peptide
  Seed: FFDETRQLC (PIK3CA R88Q)
FIDETRQLC

SEQ ID NO: 16849 - protein, 11 aa, Artificial Sequence
  Description of Artificial Sequence: Synthetic peptide
  Seed: FFDETRQLCDL (PIK3CA R88Q)
FIDETRQLCDA

SEQ ID NO: 16850 - protein, 11 aa, Artificial Sequence
  Description of Artificial Sequence: Synthetic peptide
  Seed: FFDETRQLCDL (PIK3CA R88Q)
FIDETRQLCDC

SEQ ID NO: 16851 - protein, 11 aa, Artificial Sequence
  Description of Artificial Sequence: Synthetic peptide
  Seed: FFDETRQLCDL (PIK3CA R88Q)
FIDETRQLCDF

SEQ ID NO: 16852 - protein, 11 aa, Artificial Sequence
  Description of Artificial Sequence: Synthetic peptide
  Seed: FFDETRQLCDL (PIK3CA R88Q)
FIDETRQLCDI

SEQ ID NO: 16853 - protein, 11 aa, Artificial Sequence
  Description of Artificial Sequence: Synthetic peptide
  Seed: FFDETRQLCDL (PIK3CA R88Q)
FIDETRQLCDL

SEQ ID NO: 16854 - protein, 11 aa, Artificial Sequence
  Description of Artificial Sequence: Synthetic peptide
  Seed: FFDETRQLCDL (PIK3CA R88Q)
FIDETRQLCDM

SEQ ID NO: 16855 - protein, 11 aa, Artificial Sequence
  Description of Artificial Sequence: Synthetic peptide
  Seed: FFDETRQLCDL (PIK3CA R88Q)
FIDETRQLCDV

SEQ ID NO: 16856 - protein, 11 aa, Artificial Sequence
  Description of Artificial Sequence: Synthetic peptide
  Seed: FFDETRQLCDL (PIK3CA R88Q)
FIDETRQLCDW

SEQ ID NO: 16857 - protein, 11 aa, Artificial Sequence
  Description of Artificial Sequence: Synthetic peptide
  Seed: FFDETRQLCDL (PIK3CA R88Q)
FIDETRQLCDY

SEQ ID NO: 16858 - protein, 9 aa, Artificial Sequence
  Description of Artificial Sequence: Synthetic peptide
  Seed: FFDETRQLC (PIK3CA R88Q)
FIDETRQLE

SEQ ID NO: 16859 - protein, 9 aa, Artificial Sequence
  Description of Artificial Sequence: Synthetic peptide
  Seed: FFDETRQLC (PIK3CA R88Q)
FIDETRQLF

SEQ ID NO: 16860 - protein, 9 aa, Artificial Sequence
  Description of Artificial Sequence: Synthetic peptide
  Seed: FFDETRQLC (PIK3CA R88Q)
FIDETRQLG

SEQ ID NO: 16861 - protein, 9 aa, Artificial Sequence
  Description of Artificial Sequence: Synthetic peptide
  Seed: FFDETRQLC (PIK3CA R88Q)
FIDETRQLH

SEQ ID NO: 16862 - protein, 9 aa, Artificial Sequence
  Description of Artificial Sequence: Synthetic peptide
  Seed: FFDETRQLC (PIK3CA R88Q)
FIDETRQLI

SEQ ID NO: 16863 - protein, 9 aa, Artificial Sequence
  Description of Artificial Sequence: Synthetic peptide
  Seed: FFDETRQLC (PIK3CA R88Q)
FIDETRQLK

SEQ ID NO: 16864 - protein, 9 aa, Artificial Sequence
  Description of Artificial Sequence: Synthetic peptide
  Seed: FFDETRQLC (PIK3CA R88Q)
FIDETRQLL

SEQ ID NO: 16865 - protein, 9 aa, Artificial Sequence
  Description of Artificial Sequence: Synthetic peptide
  Seed: FFDETRQLC (PIK3CA R88Q)
FIDETRQLM

SEQ ID NO: 16866 - protein, 9 aa, Artificial Sequence
  Description of Artificial Sequence: Synthetic peptide
  Seed: FFDETRQLC (PIK3CA R88Q)
FIDETRQLN

SEQ ID NO: 16867 - protein, 9 aa, Artificial Sequence
  Description of Artificial Sequence: Synthetic peptide
  Seed: FFDETRQLC (PIK3CA R88Q)
FIDETRQLP

SEQ ID NO: 16868 - protein, 9 aa, Artificial Sequence
  Description of Artificial Sequence: Synthetic peptide
  Seed: FFDETRQLC (PIK3CA R88Q)
FIDETRQLQ

SEQ ID NO: 16869 - protein, 9 aa, Artificial Sequence
  Description of Artificial Sequence: Synthetic peptide
  Seed: FFDETRQLC (PIK3CA R88Q)
FIDETRQLR

SEQ ID NO: 16870 - protein, 9 aa, Artificial Sequence
  Description of Artificial Sequence: Synthetic peptide
  Seed: FFDETRQLC (PIK3CA R88Q)
FIDETRQLS

SEQ ID NO: 16871 - protein, 9 aa, Artificial Sequence
  Description of Artificial Sequence: Synthetic peptide
  Seed: FFDETRQLC (PIK3CA R88Q)
FIDETRQLT

SEQ ID NO: 16872 - protein, 9 aa, Artificial Sequence
  Description of Artificial Sequence: Synthetic peptide
  Seed: FFDETRQLC (PIK3CA R88Q)
FIDETRQLV

SEQ ID NO: 16873 - protein, 9 aa, Artificial Sequence
  Description of Artificial Sequence: Synthetic peptide
  Seed: FFDETRQLC (PIK3CA R88Q)
FIDETRQLW

SEQ ID NO: 16874 - protein, 9 aa, Artificial Sequence
  Description of Artificial Sequence: Synthetic peptide
  Seed: FFDETRQLC (PIK3CA R88Q)
FIDETRQLY

SEQ ID NO: 16875 - protein, 8 aa, Artificial Sequence
  Description of Artificial Sequence: Synthetic peptide
  Seed: FFDETRQL (PIK3CA R88Q)
FIDETRQM

SEQ ID NO: 16876 - protein, 8 aa, Artificial Sequence
  Description of Artificial Sequence: Synthetic peptide
  Seed: FFDETRQL (PIK3CA R88Q)
FIDETRQQ

SEQ ID NO: 16877 - protein, 8 aa, Artificial Sequence
  Description of Artificial Sequence: Synthetic peptide
  Seed: FFDETRQL (PIK3CA R88Q)
FIDETRQR

SEQ ID NO: 16878 - protein, 8 aa, Artificial Sequence
  Description of Artificial Sequence: Synthetic peptide
  Seed: FFDETRQL (PIK3CA R88Q)
FIDETRQS

SEQ ID NO: 16879 - protein, 8 aa, Artificial Sequence
  Description of Artificial Sequence: Synthetic peptide
  Seed: FFDETRQL (PIK3CA R88Q)
FIDETRQT

SEQ ID NO: 16880 - protein, 8 aa, Artificial Sequence
  Description of Artificial Sequence: Synthetic peptide
  Seed: FFDETRQL (PIK3CA R88Q)
FIDETRQV

SEQ ID NO: 16881 - protein, 8 aa, Artificial Sequence
  Description of Artificial Sequence: Synthetic peptide
  Seed: FFDETRQL (PIK3CA R88Q)
FIDETRQW

SEQ ID NO: 16882 - protein, 8 aa, Artificial Sequence
  Description of Artificial Sequence: Synthetic peptide
  Seed: FFDETRQL (PIK3CA R88Q)
FIDETRQY

SEQ ID NO: 16883 - protein, 8 aa, Artificial Sequence
  Description of Artificial Sequence: Synthetic peptide
  Seed: FFDETRQL (PIK3CA R88Q)
FKDETRQF

SEQ ID NO: 16884 - protein, 8 aa, Artificial Sequence
  Description of Artificial Sequence: Synthetic peptide
  Seed: FFDETRQL (PIK3CA R88Q)
FKDETRQI

SEQ ID NO: 16885 - protein, 8 aa, Artificial Sequence
  Description of Artificial Sequence: Synthetic peptide
  Seed: FFDETRQL (PIK3CA R88Q)
FKDETRQL

SEQ ID NO: 16886 - protein, 9 aa, Artificial Sequence
  Description of Artificial Sequence: Synthetic peptide
  Seed: FFDETRQLC (PIK3CA R88Q)
FKDETRQLC

SEQ ID NO: 16887 - protein, 9 aa, Artificial Sequence
  Description of Artificial Sequence: Synthetic peptide
  Seed: FFDETRQLC (PIK3CA R88Q)
FKDETRQLF

SEQ ID NO: 16888 - protein, 9 aa, Artificial Sequence
  Description of Artificial Sequence: Synthetic peptide
  Seed: FFDETRQLC (PIK3CA R88Q)
FKDETRQLI

SEQ ID NO: 16889 - protein, 9 aa, Artificial Sequence
  Description of Artificial Sequence: Synthetic peptide
  Seed: FFDETRQLC (PIK3CA R88Q)
FKDETRQLK

SEQ ID NO: 16890 - protein, 9 aa, Artificial Sequence
  Description of Artificial Sequence: Synthetic peptide
  Seed: FFDETRQLC (PIK3CA R88Q)
FKDETRQLL

SEQ ID NO: 16891 - protein, 9 aa, Artificial Sequence
  Description of Artificial Sequence: Synthetic peptide
  Seed: FFDETRQLC (PIK3CA R88Q)
FKDETRQLM

SEQ ID NO: 16892 - protein, 9 aa, Artificial Sequence
  Description of Artificial Sequence: Synthetic peptide
  Seed: FFDETRQLC (PIK3CA R88Q)
FKDETRQLV

SEQ ID NO: 16893 - protein, 9 aa, Artificial Sequence
  Description of Artificial Sequence: Synthetic peptide
  Seed: FFDETRQLC (PIK3CA R88Q)
FKDETRQLW

SEQ ID NO: 16894 - protein, 9 aa, Artificial Sequence
  Description of Artificial Sequence: Synthetic peptide
  Seed: FFDETRQLC (PIK3CA R88Q)
FKDETRQLY

SEQ ID NO: 16895 - protein, 8 aa, Artificial Sequence
  Description of Artificial Sequence: Synthetic peptide
  Seed: FFDETRQL (PIK3CA R88Q)
FKDETRQM

SEQ ID NO: 16896 - protein, 8 aa, Artificial Sequence
  Description of Artificial Sequence: Synthetic peptide
  Seed: FFDETRQL (PIK3CA R88Q)
FKDETRQV

SEQ ID NO: 16897 - protein, 8 aa, Artificial Sequence
  Description of Artificial Sequence: Synthetic peptide
  Seed: FFDETRQL (PIK3CA R88Q)
FKDETRQW

SEQ ID NO: 16898 - protein, 8 aa, Artificial Sequence
  Description of Artificial Sequence: Synthetic peptide
  Seed: FFDETRQL (PIK3CA R88Q)
FKDETRQY

SEQ ID NO: 16899 - protein, 8 aa, Artificial Sequence
  Description of Artificial Sequence: Synthetic peptide
  Seed: FFDETRQL (PIK3CA R88Q)
FLDETRQA

SEQ ID NO: 16900 - protein, 8 aa, Artificial Sequence
  Description of Artificial Sequence: Synthetic peptide
  Seed: FFDETRQL (PIK3CA R88Q)
FLDETRQC

SEQ ID NO: 16901 - protein, 8 aa, Artificial Sequence
  Description of Artificial Sequence: Synthetic peptide
  Seed: FFDETRQL (PIK3CA R88Q)
FLDETRQF

SEQ ID NO: 16902 - protein, 8 aa, Artificial Sequence
  Description of Artificial Sequence: Synthetic peptide
  Seed: FFDETRQL (PIK3CA R88Q)
FLDETRQI

SEQ ID NO: 16903 - protein, 8 aa, Artificial Sequence
  Description of Artificial Sequence: Synthetic peptide
  Seed: FFDETRQL (PIK3CA R88Q)
FLDETRQK

SEQ ID NO: 16904 - protein, 8 aa, Artificial Sequence
  Description of Artificial Sequence: Synthetic peptide
  Seed: FFDETRQL (PIK3CA R88Q)
FLDETRQL

SEQ ID NO: 16905 - protein, 9 aa, Artificial Sequence
  Description of Artificial Sequence: Synthetic peptide
  Seed: FFDETRQLC (PIK3CA R88Q)
FLDETRQLA

SEQ ID NO: 16906 - protein, 9 aa, Artificial Sequence
  Description of Artificial Sequence: Synthetic peptide
  Seed: FFDETRQLC (PIK3CA R88Q)
FLDETRQLC

SEQ ID NO: 16907 - protein, 11 aa, Artificial Sequence
  Description of Artificial Sequence: Synthetic peptide
  Seed: FFDETRQLCDL (PIK3CA R88Q)
FLDETRQLCDC

SEQ ID NO: 16908 - protein, 11 aa, Artificial Sequence
  Description of Artificial Sequence: Synthetic peptide
  Seed: FFDETRQLCDL (PIK3CA R88Q)
FLDETRQLCDF

SEQ ID NO: 16909 - protein, 11 aa, Artificial Sequence
  Description of Artificial Sequence: Synthetic peptide
  Seed: FFDETRQLCDL (PIK3CA R88Q)
FLDETRQLCDI

SEQ ID NO: 16910 - protein, 11 aa, Artificial Sequence
  Description of Artificial Sequence: Synthetic peptide
  Seed: FFDETRQLCDL (PIK3CA R88Q)
FLDETRQLCDL

SEQ ID NO: 16911 - protein, 11 aa, Artificial Sequence
  Description of Artificial Sequence: Synthetic peptide
  Seed: FFDETRQLCDL (PIK3CA R88Q)
FLDETRQLCDM

SEQ ID NO: 16912 - protein, 11 aa, Artificial Sequence
  Description of Artificial Sequence: Synthetic peptide
  Seed: FFDETRQLCDL (PIK3CA R88Q)
FLDETRQLCDV

SEQ ID NO: 16913 - protein, 11 aa, Artificial Sequence
  Description of Artificial Sequence: Synthetic peptide
  Seed: FFDETRQLCDL (PIK3CA R88Q)
FLDETRQLCDW

SEQ ID NO: 16914 - protein, 11 aa, Artificial Sequence
  Description of Artificial Sequence: Synthetic peptide
  Seed: FFDETRQLCDL (PIK3CA R88Q)
FLDETRQLCDY

SEQ ID NO: 16915 - protein, 9 aa, Artificial Sequence
  Description of Artificial Sequence: Synthetic peptide
  Seed: FFDETRQLC (PIK3CA R88Q)
FLDETRQLE

SEQ ID NO: 16916 - protein, 9 aa, Artificial Sequence
  Description of Artificial Sequence: Synthetic peptide
  Seed: FFDETRQLC (PIK3CA R88Q)
FLDETRQLF

SEQ ID NO: 16917 - protein, 9 aa, Artificial Sequence
  Description of Artificial Sequence: Synthetic peptide
  Seed: FFDETRQLC (PIK3CA R88Q)
FLDETRQLG

SEQ ID NO: 16918 - protein, 9 aa, Artificial Sequence
  Description of Artificial Sequence: Synthetic peptide
  Seed: FFDETRQLC (PIK3CA R88Q)
FLDETRQLH

SEQ ID NO: 16919 - protein, 9 aa, Artificial Sequence
  Description of Artificial Sequence: Synthetic peptide
  Seed: FFDETRQLC (PIK3CA R88Q)
FLDETRQLI

SEQ ID NO: 16920 - protein, 9 aa, Artificial Sequence
  Description of Artificial Sequence: Synthetic peptide
  Seed: FFDETRQLC (PIK3CA R88Q)
FLDETRQLK

SEQ ID NO: 16921 - protein, 9 aa, Artificial Sequence
  Description of Artificial Sequence: Synthetic peptide
  Seed: FFDETRQLC (PIK3CA R88Q)
FLDETRQLL

SEQ ID NO: 16922 - protein, 9 aa, Artificial Sequence
  Description of Artificial Sequence: Synthetic peptide
  Seed: FFDETRQLC (PIK3CA R88Q)
FLDETRQLM

SEQ ID NO: 16923 - protein, 9 aa, Artificial Sequence
  Description of Artificial Sequence: Synthetic peptide
  Seed: FFDETRQLC (PIK3CA R88Q)
FLDETRQLN

SEQ ID NO: 16924 - protein, 9 aa, Artificial Sequence
  Description of Artificial Sequence: Synthetic peptide
  Seed: FFDETRQLC (PIK3CA R88Q)
FLDETRQLP

SEQ ID NO: 16925 - protein, 9 aa, Artificial Sequence
  Description of Artificial Sequence: Synthetic peptide
  Seed: FFDETRQLC (PIK3CA R88Q)
FLDETRQLQ

SEQ ID NO: 16926 - protein, 9 aa, Artificial Sequence
  Description of Artificial Sequence: Synthetic peptide
  Seed: FFDETRQLC (PIK3CA R88Q)
FLDETRQLR

SEQ ID NO: 16927 - protein, 9 aa, Artificial Sequence
  Description of Artificial Sequence: Synthetic peptide
  Seed: FFDETRQLC (PIK3CA R88Q)
FLDETRQLS

SEQ ID NO: 16928 - protein, 9 aa, Artificial Sequence
  Description of Artificial Sequence: Synthetic peptide
  Seed: FFDETRQLC (PIK3CA R88Q)
FLDETRQLT

SEQ ID NO: 16929 - protein, 9 aa, Artificial Sequence
  Description of Artificial Sequence: Synthetic peptide
  Seed: FFDETRQLC (PIK3CA R88Q)
FLDETRQLV

SEQ ID NO: 16930 - protein, 9 aa, Artificial Sequence
  Description of Artificial Sequence: Synthetic peptide
  Seed: FFDETRQLC (PIK3CA R88Q)
FLDETRQLW

SEQ ID NO: 16931 - protein, 9 aa, Artificial Sequence
  Description of Artificial Sequence: Synthetic peptide
  Seed: FFDETRQLC (PIK3CA R88Q)
FLDETRQLY

SEQ ID NO: 16932 - protein, 8 aa, Artificial Sequence
  Description of Artificial Sequence: Synthetic peptide
  Seed: FFDETRQL (PIK3CA R88Q)
FLDETRQM

SEQ ID NO: 16933 - protein, 8 aa, Artificial Sequence
  Description of Artificial Sequence: Synthetic peptide
  Seed: FFDETRQL (PIK3CA R88Q)
FLDETRQR

SEQ ID NO: 16934 - protein, 8 aa, Artificial Sequence
  Description of Artificial Sequence: Synthetic peptide
  Seed: FFDETRQL (PIK3CA R88Q)
FLDETRQT

SEQ ID NO: 16935 - protein, 8 aa, Artificial Sequence
  Description of Artificial Sequence: Synthetic peptide
  Seed: FFDETRQL (PIK3CA R88Q)
FLDETRQV

SEQ ID NO: 16936 - protein, 8 aa, Artificial Sequence
  Description of Artificial Sequence: Synthetic peptide
  Seed: FFDETRQL (PIK3CA R88Q)
FLDETRQW

SEQ ID NO: 16937 - protein, 8 aa, Artificial Sequence
  Description of Artificial Sequence: Synthetic peptide
  Seed: FFDETRQL (PIK3CA R88Q)
FLDETRQY

SEQ ID NO: 16938 - protein, 8 aa, Artificial Sequence
  Description of Artificial Sequence: Synthetic peptide
  Seed: FFDETRQL (PIK3CA R88Q)
FMDETRQA

SEQ ID NO: 16939 - protein, 8 aa, Artificial Sequence
  Description of Artificial Sequence: Synthetic peptide
  Seed: FFDETRQL (PIK3CA R88Q)
FMDETRQC

SEQ ID NO: 16940 - protein, 8 aa, Artificial Sequence
  Description of Artificial Sequence: Synthetic peptide
  Seed: FFDETRQL (PIK3CA R88Q)
FMDETRQF

SEQ ID NO: 16941 - protein, 8 aa, Artificial Sequence
  Description of Artificial Sequence: Synthetic peptide
  Seed: FFDETRQL (PIK3CA R88Q)
FMDETRQI

SEQ ID NO: 16942 - protein, 8 aa, Artificial Sequence
  Description of Artificial Sequence: Synthetic peptide
  Seed: FFDETRQL (PIK3CA R88Q)
FMDETRQK

SEQ ID NO: 16943 - protein, 8 aa, Artificial Sequence
  Description of Artificial Sequence: Synthetic peptide
  Seed: FFDETRQL (PIK3CA R88Q)
FMDETRQL

SEQ ID NO: 16944 - protein, 9 aa, Artificial Sequence
  Description of Artificial Sequence: Synthetic peptide
  Seed: FFDETRQLC (PIK3CA R88Q)
FMDETRQLA

SEQ ID NO: 16945 - protein, 9 aa, Artificial Sequence
  Description of Artificial Sequence: Synthetic peptide
  Seed: FFDETRQLC (PIK3CA R88Q)
FMDETRQLC

SEQ ID NO: 16946 - protein, 11 aa, Artificial Sequence
  Description of Artificial Sequence: Synthetic peptide
  Seed: FFDETRQLCDL (PIK3CA R88Q)
FMDETRQLCDC

SEQ ID NO: 16947 - protein, 11 aa, Artificial Sequence
  Description of Artificial Sequence: Synthetic peptide
  Seed: FFDETRQLCDL (PIK3CA R88Q)
FMDETRQLCDF

SEQ ID NO: 16948 - protein, 11 aa, Artificial Sequence
  Description of Artificial Sequence: Synthetic peptide
  Seed: FFDETRQLCDL (PIK3CA R88Q)
FMDETRQLCDI

SEQ ID NO: 16949 - protein, 11 aa, Artificial Sequence
  Description of Artificial Sequence: Synthetic peptide
  Seed: FFDETRQLCDL (PIK3CA R88Q)
FMDETRQLCDL

SEQ ID NO: 16950 - protein, 11 aa, Artificial Sequence
  Description of Artificial Sequence: Synthetic peptide
  Seed: FFDETRQLCDL (PIK3CA R88Q)
FMDETRQLCDM

SEQ ID NO: 16951 - protein, 11 aa, Artificial Sequence
  Description of Artificial Sequence: Synthetic peptide
  Seed: FFDETRQLCDL (PIK3CA R88Q)
FMDETRQLCDV

SEQ ID NO: 16952 - protein, 11 aa, Artificial Sequence
  Description of Artificial Sequence: Synthetic peptide
  Seed: FFDETRQLCDL (PIK3CA R88Q)
FMDETRQLCDW

SEQ ID NO: 16953 - protein, 11 aa, Artificial Sequence
  Description of Artificial Sequence: Synthetic peptide
  Seed: FFDETRQLCDL (PIK3CA R88Q)
FMDETRQLCDY

SEQ ID NO: 16954 - protein, 9 aa, Artificial Sequence
  Description of Artificial Sequence: Synthetic peptide
  Seed: FFDETRQLC (PIK3CA R88Q)
FMDETRQLE

SEQ ID NO: 16955 - protein, 9 aa, Artificial Sequence
  Description of Artificial Sequence: Synthetic peptide
  Seed: FFDETRQLC (PIK3CA R88Q)
FMDETRQLF

SEQ ID NO: 16956 - protein, 9 aa, Artificial Sequence
  Description of Artificial Sequence: Synthetic peptide
  Seed: FFDETRQLC (PIK3CA R88Q)
FMDETRQLG

SEQ ID NO: 16957 - protein, 9 aa, Artificial Sequence
  Description of Artificial Sequence: Synthetic peptide
  Seed: FFDETRQLC (PIK3CA R88Q)
FMDETRQLH

SEQ ID NO: 16958 - protein, 9 aa, Artificial Sequence
  Description of Artificial Sequence: Synthetic peptide
  Seed: FFDETRQLC (PIK3CA R88Q)
FMDETRQLI

SEQ ID NO: 16959 - protein, 9 aa, Artificial Sequence
  Description of Artificial Sequence: Synthetic peptide
  Seed: FFDETRQLC (PIK3CA R88Q)
FMDETRQLK

SEQ ID NO: 16960 - protein, 9 aa, Artificial Sequence
  Description of Artificial Sequence: Synthetic peptide
  Seed: FFDETRQLC (PIK3CA R88Q)
FMDETRQLL

SEQ ID NO: 16961 - protein, 9 aa, Artificial Sequence
  Description of Artificial Sequence: Synthetic peptide
  Seed: FFDETRQLC (PIK3CA R88Q)
FMDETRQLM

SEQ ID NO: 16962 - protein, 9 aa, Artificial Sequence
  Description of Artificial Sequence: Synthetic peptide
  Seed: FFDETRQLC (PIK3CA R88Q)
FMDETRQLP

SEQ ID NO: 16963 - protein, 9 aa, Artificial Sequence
  Description of Artificial Sequence: Synthetic peptide
  Seed: FFDETRQLC (PIK3CA R88Q)
FMDETRQLQ

SEQ ID NO: 16964 - protein, 9 aa, Artificial Sequence
  Description of Artificial Sequence: Synthetic peptide
  Seed: FFDETRQLC (PIK3CA R88Q)
FMDETRQLR

SEQ ID NO: 16965 - protein, 9 aa, Artificial Sequence
  Description of Artificial Sequence: Synthetic peptide
  Seed: FFDETRQLC (PIK3CA R88Q)
FMDETRQLS

SEQ ID NO: 16966 - protein, 9 aa, Artificial Sequence
  Description of Artificial Sequence: Synthetic peptide
  Seed: FFDETRQLC (PIK3CA R88Q)
FMDETRQLT

SEQ ID NO: 16967 - protein, 9 aa, Artificial Sequence
  Description of Artificial Sequence: Synthetic peptide
  Seed: FFDETRQLC (PIK3CA R88Q)
FMDETRQLV

SEQ ID NO: 16968 - protein, 9 aa, Artificial Sequence
  Description of Artificial Sequence: Synthetic peptide
  Seed: FFDETRQLC (PIK3CA R88Q)
FMDETRQLW

SEQ ID NO: 16969 - protein, 9 aa, Artificial Sequence
  Description of Artificial Sequence: Synthetic peptide
  Seed: FFDETRQLC (PIK3CA R88Q)
FMDETRQLY

SEQ ID NO: 16970 - protein, 8 aa, Artificial Sequence
  Description of Artificial Sequence: Synthetic peptide
  Seed: FFDETRQL (PIK3CA R88Q)
FMDETRQR

SEQ ID NO: 16971 - protein, 8 aa, Artificial Sequence
  Description of Artificial Sequence: Synthetic peptide
  Seed: FFDETRQL (PIK3CA R88Q)
FMDETRQT

SEQ ID NO: 16972 - protein, 8 aa, Artificial Sequence
  Description of Artificial Sequence: Synthetic peptide
  Seed: FFDETRQL (PIK3CA R88Q)
FMDETRQV

SEQ ID NO: 16973 - protein, 8 aa, Artificial Sequence
  Description of Artificial Sequence: Synthetic peptide
  Seed: FFDETRQL (PIK3CA R88Q)
FMDETRQW

SEQ ID NO: 16974 - protein, 8 aa, Artificial Sequence
  Description of Artificial Sequence: Synthetic peptide
  Seed: FFDETRQL (PIK3CA R88Q)
FMDETRQY

SEQ ID NO: 16975 - protein, 8 aa, Artificial Sequence
  Description of Artificial Sequence: Synthetic peptide
  Seed: FFDETRQL (PIK3CA R88Q)
FNDETRQA

SEQ ID NO: 16976 - protein, 8 aa, Artificial Sequence
  Description of Artificial Sequence: Synthetic peptide
  Seed: FFDETRQL (PIK3CA R88Q)
FNDETRQC

SEQ ID NO: 16977 - protein, 8 aa, Artificial Sequence
  Description of Artificial Sequence: Synthetic peptide
  Seed: FFDETRQL (PIK3CA R88Q)
FNDETRQF

SEQ ID NO: 16978 - protein, 8 aa, Artificial Sequence
  Description of Artificial Sequence: Synthetic peptide
  Seed: FFDETRQL (PIK3CA R88Q)
FNDETRQI

SEQ ID NO: 16979 - protein, 8 aa, Artificial Sequence
  Description of Artificial Sequence: Synthetic peptide
  Seed: FFDETRQL (PIK3CA R88Q)
FNDETRQK

SEQ ID NO: 16980 - protein, 8 aa, Artificial Sequence
  Description of Artificial Sequence: Synthetic peptide
  Seed: FFDETRQL (PIK3CA R88Q)
FNDETRQL

SEQ ID NO: 16981 - protein, 9 aa, Artificial Sequence
  Description of Artificial Sequence: Synthetic peptide
  Seed: FFDETRQLC (PIK3CA R88Q)
FNDETRQLA

SEQ ID NO: 16982 - protein, 9 aa, Artificial Sequence
  Description of Artificial Sequence: Synthetic peptide
  Seed: FFDETRQLC (PIK3CA R88Q)
FNDETRQLC

SEQ ID NO: 16983 - protein, 11 aa, Artificial Sequence
  Description of Artificial Sequence: Synthetic peptide
  Seed: FFDETRQLCDL (PIK3CA R88Q)
FNDETRQLCDF

SEQ ID NO: 16984 - protein, 11 aa, Artificial Sequence
  Description of Artificial Sequence: Synthetic peptide
  Seed: FFDETRQLCDL (PIK3CA R88Q)
FNDETRQLCDI

SEQ ID NO: 16985 - protein, 11 aa, Artificial Sequence
  Description of Artificial Sequence: Synthetic peptide
  Seed: FFDETRQLCDL (PIK3CA R88Q)
FNDETRQLCDL

SEQ ID NO: 16986 - protein, 11 aa, Artificial Sequence
  Description of Artificial Sequence: Synthetic peptide
  Seed: FFDETRQLCDL (PIK3CA R88Q)
FNDETRQLCDM

SEQ ID NO: 16987 - protein, 11 aa, Artificial Sequence
  Description of Artificial Sequence: Synthetic peptide
  Seed: FFDETRQLCDL (PIK3CA R88Q)
FNDETRQLCDV

SEQ ID NO: 16988 - protein, 9 aa, Artificial Sequence
  Description of Artificial Sequence: Synthetic peptide
  Seed: FFDETRQLC (PIK3CA R88Q)
FNDETRQLF

SEQ ID NO: 16989 - protein, 9 aa, Artificial Sequence
  Description of Artificial Sequence: Synthetic peptide
  Seed: FFDETRQLC (PIK3CA R88Q)
FNDETRQLI

SEQ ID NO: 16990 - protein, 9 aa, Artificial Sequence
  Description of Artificial Sequence: Synthetic peptide
  Seed: FFDETRQLC (PIK3CA R88Q)
FNDETRQLK

SEQ ID NO: 16991 - protein, 9 aa, Artificial Sequence
  Description of Artificial Sequence: Synthetic peptide
  Seed: FFDETRQLC (PIK3CA R88Q)
FNDETRQLL

SEQ ID NO: 16992 - protein, 9 aa, Artificial Sequence
  Description of Artificial Sequence: Synthetic peptide
  Seed: FFDETRQLC (PIK3CA R88Q)
FNDETRQLM

SEQ ID NO: 16993 - protein, 9 aa, Artificial Sequence
  Description of Artificial Sequence: Synthetic peptide
  Seed: FFDETRQLC (PIK3CA R88Q)
FNDETRQLR

SEQ ID NO: 16994 - protein, 9 aa, Artificial Sequence
  Description of Artificial Sequence: Synthetic peptide
  Seed: FFDETRQLC (PIK3CA R88Q)
FNDETRQLS

SEQ ID NO: 16995 - protein, 9 aa, Artificial Sequence
  Description of Artificial Sequence: Synthetic peptide
  Seed: FFDETRQLC (PIK3CA R88Q)
FNDETRQLT

SEQ ID NO: 16996 - protein, 9 aa, Artificial Sequence
  Description of Artificial Sequence: Synthetic peptide
  Seed: FFDETRQLC (PIK3CA R88Q)
FNDETRQLV

SEQ ID NO: 16997 - protein, 9 aa, Artificial Sequence
  Description of Artificial Sequence: Synthetic peptide
  Seed: FFDETRQLC (PIK3CA R88Q)
FNDETRQLW

SEQ ID NO: 16998 - protein, 9 aa, Artificial Sequence
  Description of Artificial Sequence: Synthetic peptide
  Seed: FFDETRQLC (PIK3CA R88Q)
FNDETRQLY

SEQ ID NO: 16999 - protein, 8 aa, Artificial Sequence
  Description of Artificial Sequence: Synthetic peptide
  Seed: FFDETRQL (PIK3CA R88Q)
FNDETRQM

SEQ ID NO: 17000 - protein, 8 aa, Artificial Sequence
  Description of Artificial Sequence: Synthetic peptide
  Seed: FFDETRQL (PIK3CA R88Q)
FNDETRQR

SEQ ID NO: 17001 - protein, 8 aa, Artificial Sequence
  Description of Artificial Sequence: Synthetic peptide
  Seed: FFDETRQL (PIK3CA R88Q)
FNDETRQV

SEQ ID NO: 17002 - protein, 8 aa, Artificial Sequence
  Description of Artificial Sequence: Synthetic peptide
  Seed: FFDETRQL (PIK3CA R88Q)
FNDETRQW

SEQ ID NO: 17003 - protein, 8 aa, Artificial Sequence
  Description of Artificial Sequence: Synthetic peptide
  Seed: FFDETRQL (PIK3CA R88Q)
FNDETRQY

SEQ ID NO: 17004 - protein, 8 aa, Artificial Sequence
  Description of Artificial Sequence: Synthetic peptide
  Seed: FFDETRQL (PIK3CA R88Q)
FPDETRQA

SEQ ID NO: 17005 - protein, 8 aa, Artificial Sequence
  Description of Artificial Sequence: Synthetic peptide
  Seed: FFDETRQL (PIK3CA R88Q)
FPDETRQF

SEQ ID NO: 17006 - protein, 8 aa, Artificial Sequence
  Description of Artificial Sequence: Synthetic peptide
  Seed: FFDETRQL (PIK3CA R88Q)
FPDETRQI

SEQ ID NO: 17007 - protein, 8 aa, Artificial Sequence
  Description of Artificial Sequence: Synthetic peptide
  Seed: FFDETRQL (PIK3CA R88Q)
FPDETRQL

SEQ ID NO: 17008 - protein, 9 aa, Artificial Sequence
  Description of Artificial Sequence: Synthetic peptide
  Seed: FFDETRQLC (PIK3CA R88Q)
FPDETRQLA

SEQ ID NO: 17009 - protein, 9 aa, Artificial Sequence
  Description of Artificial Sequence: Synthetic peptide
  Seed: FFDETRQLC (PIK3CA R88Q)
FPDETRQLC

SEQ ID NO: 17010 - protein, 11 aa, Artificial Sequence
  Description of Artificial Sequence: Synthetic peptide
  Seed: FFDETRQLCDL (PIK3CA R88Q)
FPDETRQLCDF

SEQ ID NO: 17011 - protein, 11 aa, Artificial Sequence
  Description of Artificial Sequence: Synthetic peptide
  Seed: FFDETRQLCDL (PIK3CA R88Q)
FPDETRQLCDI

SEQ ID NO: 17012 - protein, 11 aa, Artificial Sequence
  Description of Artificial Sequence: Synthetic peptide
  Seed: FFDETRQLCDL (PIK3CA R88Q)
FPDETRQLCDL

SEQ ID NO: 17013 - protein, 11 aa, Artificial Sequence
  Description of Artificial Sequence: Synthetic peptide
  Seed: FFDETRQLCDL (PIK3CA R88Q)
FPDETRQLCDM

SEQ ID NO: 17014 - protein, 11 aa, Artificial Sequence
  Description of Artificial Sequence: Synthetic peptide
  Seed: FFDETRQLCDL (PIK3CA R88Q)
FPDETRQLCDV

SEQ ID NO: 17015 - protein, 9 aa, Artificial Sequence
  Description of Artificial Sequence: Synthetic peptide
  Seed: FFDETRQLC (PIK3CA R88Q)
FPDETRQLF

SEQ ID NO: 17016 - protein, 9 aa, Artificial Sequence
  Description of Artificial Sequence: Synthetic peptide
  Seed: FFDETRQLC (PIK3CA R88Q)
FPDETRQLG

SEQ ID NO: 17017 - protein, 9 aa, Artificial Sequence
  Description of Artificial Sequence: Synthetic peptide
  Seed: FFDETRQLC (PIK3CA R88Q)
FPDETRQLH

SEQ ID NO: 17018 - protein, 9 aa, Artificial Sequence
  Description of Artificial Sequence: Synthetic peptide
  Seed: FFDETRQLC (PIK3CA R88Q)
FPDETRQLI

SEQ ID NO: 17019 - protein, 9 aa, Artificial Sequence
  Description of Artificial Sequence: Synthetic peptide
  Seed: FFDETRQLC (PIK3CA R88Q)
FPDETRQLK

SEQ ID NO: 17020 - protein, 9 aa, Artificial Sequence
  Description of Artificial Sequence: Synthetic peptide
  Seed: FFDETRQLC (PIK3CA R88Q)
FPDETRQLL

SEQ ID NO: 17021 - protein, 9 aa, Artificial Sequence
  Description of Artificial Sequence: Synthetic peptide
  Seed: FFDETRQLC (PIK3CA R88Q)
FPDETRQLM

SEQ ID NO: 17022 - protein, 9 aa, Artificial Sequence
  Description of Artificial Sequence: Synthetic peptide
  Seed: FFDETRQLC (PIK3CA R88Q)
FPDETRQLP

SEQ ID NO: 17023 - protein, 9 aa, Artificial Sequence
  Description of Artificial Sequence: Synthetic peptide
  Seed: FFDETRQLC (PIK3CA R88Q)
FPDETRQLR

SEQ ID NO: 17024 - protein, 9 aa, Artificial Sequence
  Description of Artificial Sequence: Synthetic peptide
  Seed: FFDETRQLC (PIK3CA R88Q)
FPDETRQLS

SEQ ID NO: 17025 - protein, 9 aa, Artificial Sequence
  Description of Artificial Sequence: Synthetic peptide
  Seed: FFDETRQLC (PIK3CA R88Q)
FPDETRQLT

SEQ ID NO: 17026 - protein, 9 aa, Artificial Sequence
  Description of Artificial Sequence: Synthetic peptide
  Seed: FFDETRQLC (PIK3CA R88Q)
FPDETRQLV

SEQ ID NO: 17027 - protein, 9 aa, Artificial Sequence
  Description of Artificial Sequence: Synthetic peptide
  Seed: FFDETRQLC (PIK3CA R88Q)
FPDETRQLW

SEQ ID NO: 17028 - protein, 9 aa, Artificial Sequence
  Description of Artificial Sequence: Synthetic peptide
  Seed: FFDETRQLC (PIK3CA R88Q)
FPDETRQLY

SEQ ID NO: 17029 - protein, 8 aa, Artificial Sequence
  Description of Artificial Sequence: Synthetic peptide
  Seed: FFDETRQL (PIK3CA R88Q)
FPDETRQM

SEQ ID NO: 17030 - protein, 8 aa, Artificial Sequence
  Description of Artificial Sequence: Synthetic peptide
  Seed: FFDETRQL (PIK3CA R88Q)
FPDETRQV

SEQ ID NO: 17031 - protein, 8 aa, Artificial Sequence
  Description of Artificial Sequence: Synthetic peptide
  Seed: FFDETRQL (PIK3CA R88Q)
FPDETRQW

SEQ ID NO: 17032 - protein, 8 aa, Artificial Sequence
  Description of Artificial Sequence: Synthetic peptide
  Seed: FFDETRQL (PIK3CA R88Q)
FPDETRQY

SEQ ID NO: 17033 - protein, 8 aa, Artificial Sequence
  Description of Artificial Sequence: Synthetic peptide
  Seed: FFDETRQL (PIK3CA R88Q)
FQDETRQA

SEQ ID NO: 17034 - protein, 8 aa, Artificial Sequence
  Description of Artificial Sequence: Synthetic peptide
  Seed: FFDETRQL (PIK3CA R88Q)
FQDETRQC

SEQ ID NO: 17035 - protein, 8 aa, Artificial Sequence
  Description of Artificial Sequence: Synthetic peptide
  Seed: FFDETRQL (PIK3CA R88Q)
FQDETRQF

SEQ ID NO: 17036 - protein, 8 aa, Artificial Sequence
  Description of Artificial Sequence: Synthetic peptide
  Seed: FFDETRQL (PIK3CA R88Q)
FQDETRQI

SEQ ID NO: 17037 - protein, 8 aa, Artificial Sequence
  Description of Artificial Sequence: Synthetic peptide
  Seed: FFDETRQL (PIK3CA R88Q)
FQDETRQK

SEQ ID NO: 17038 - protein, 8 aa, Artificial Sequence
  Description of Artificial Sequence: Synthetic peptide
  Seed: FFDETRQL (PIK3CA R88Q)
FQDETRQL

SEQ ID NO: 17039 - protein, 9 aa, Artificial Sequence
  Description of Artificial Sequence: Synthetic peptide
  Seed: FFDETRQLC (PIK3CA R88Q)
FQDETRQLA

SEQ ID NO: 17040 - protein, 9 aa, Artificial Sequence
  Description of Artificial Sequence: Synthetic peptide
  Seed: FFDETRQLC (PIK3CA R88Q)
FQDETRQLC

SEQ ID NO: 17041 - protein, 11 aa, Artificial Sequence
  Description of Artificial Sequence: Synthetic peptide
  Seed: FFDETRQLCDL (PIK3CA R88Q)
FQDETRQLCDF

SEQ ID NO: 17042 - protein, 11 aa, Artificial Sequence
  Description of Artificial Sequence: Synthetic peptide
  Seed: FFDETRQLCDL (PIK3CA R88Q)
FQDETRQLCDI

SEQ ID NO: 17043 - protein, 11 aa, Artificial Sequence
  Description of Artificial Sequence: Synthetic peptide
  Seed: FFDETRQLCDL (PIK3CA R88Q)
FQDETRQLCDL

SEQ ID NO: 17044 - protein, 11 aa, Artificial Sequence
  Description of Artificial Sequence: Synthetic peptide
  Seed: FFDETRQLCDL (PIK3CA R88Q)
FQDETRQLCDM

SEQ ID NO: 17045 - protein, 11 aa, Artificial Sequence
  Description of Artificial Sequence: Synthetic peptide
  Seed: FFDETRQLCDL (PIK3CA R88Q)
FQDETRQLCDV

SEQ ID NO: 17046 - protein, 9 aa, Artificial Sequence
  Description of Artificial Sequence: Synthetic peptide
  Seed: FFDETRQLC (PIK3CA R88Q)
FQDETRQLF

SEQ ID NO: 17047 - protein, 9 aa, Artificial Sequence
  Description of Artificial Sequence: Synthetic peptide
  Seed: FFDETRQLC (PIK3CA R88Q)
FQDETRQLI

SEQ ID NO: 17048 - protein, 9 aa, Artificial Sequence
  Description of Artificial Sequence: Synthetic peptide
  Seed: FFDETRQLC (PIK3CA R88Q)
FQDETRQLK

SEQ ID NO: 17049 - protein, 9 aa, Artificial Sequence
  Description of Artificial Sequence: Synthetic peptide
  Seed: FFDETRQLC (PIK3CA R88Q)
FQDETRQLL

SEQ ID NO: 17050 - protein, 9 aa, Artificial Sequence
  Description of Artificial Sequence: Synthetic peptide
  Seed: FFDETRQLC (PIK3CA R88Q)
FQDETRQLM

SEQ ID NO: 17051 - protein, 9 aa, Artificial Sequence
  Description of Artificial Sequence: Synthetic peptide
  Seed: FFDETRQLC (PIK3CA R88Q)
FQDETRQLQ

SEQ ID NO: 17052 - protein, 9 aa, Artificial Sequence
  Description of Artificial Sequence: Synthetic peptide
  Seed: FFDETRQLC (PIK3CA R88Q)
FQDETRQLR

SEQ ID NO: 17053 - protein, 9 aa, Artificial Sequence
  Description of Artificial Sequence: Synthetic peptide
  Seed: FFDETRQLC (PIK3CA R88Q)
FQDETRQLS

SEQ ID NO: 17054 - protein, 9 aa, Artificial Sequence
  Description of Artificial Sequence: Synthetic peptide
  Seed: FFDETRQLC (PIK3CA R88Q)
FQDETRQLT

SEQ ID NO: 17055 - protein, 9 aa, Artificial Sequence
  Description of Artificial Sequence: Synthetic peptide
  Seed: FFDETRQLC (PIK3CA R88Q)
FQDETRQLV

SEQ ID NO: 17056 - protein, 9 aa, Artificial Sequence
  Description of Artificial Sequence: Synthetic peptide
  Seed: FFDETRQLC (PIK3CA R88Q)
FQDETRQLW

SEQ ID NO: 17057 - protein, 9 aa, Artificial Sequence
  Description of Artificial Sequence: Synthetic peptide
  Seed: FFDETRQLC (PIK3CA R88Q)
FQDETRQLY

SEQ ID NO: 17058 - protein, 8 aa, Artificial Sequence
  Description of Artificial Sequence: Synthetic peptide
  Seed: FFDETRQL (PIK3CA R88Q)
FQDETRQM

SEQ ID NO: 17059 - protein, 8 aa, Artificial Sequence
  Description of Artificial Sequence: Synthetic peptide
  Seed: FFDETRQL (PIK3CA R88Q)
FQDETRQR

SEQ ID NO: 17060 - protein, 8 aa, Artificial Sequence
  Description of Artificial Sequence: Synthetic peptide
  Seed: FFDETRQL (PIK3CA R88Q)
FQDETRQV

SEQ ID NO: 17061 - protein, 8 aa, Artificial Sequence
  Description of Artificial Sequence: Synthetic peptide
  Seed: FFDETRQL (PIK3CA R88Q)
FQDETRQW

SEQ ID NO: 17062 - protein, 8 aa, Artificial Sequence
  Description of Artificial Sequence: Synthetic peptide
  Seed: FFDETRQL (PIK3CA R88Q)
FQDETRQY

SEQ ID NO: 17063 - protein, 8 aa, Artificial Sequence
  Description of Artificial Sequence: Synthetic peptide
  Seed: FFDETRQL (PIK3CA R88Q)
FRDETRQF

SEQ ID NO: 17064 - protein, 8 aa, Artificial Sequence
  Description of Artificial Sequence: Synthetic peptide
  Seed: FFDETRQL (PIK3CA R88Q)
FRDETRQI

SEQ ID NO: 17065 - protein, 8 aa, Artificial Sequence
  Description of Artificial Sequence: Synthetic peptide
  Seed: FFDETRQL (PIK3CA R88Q)
FRDETRQL

SEQ ID NO: 17066 - protein, 9 aa, Artificial Sequence
  Description of Artificial Sequence: Synthetic peptide
  Seed: FFDETRQLC (PIK3CA R88Q)
FRDETRQLA

SEQ ID NO: 17067 - protein, 9 aa, Artificial Sequence
  Description of Artificial Sequence: Synthetic peptide
  Seed: FFDETRQLC (PIK3CA R88Q)
FRDETRQLC

SEQ ID NO: 17068 - protein, 11 aa, Artificial Sequence
  Description of Artificial Sequence: Synthetic peptide
  Seed: FFDETRQLCDL (PIK3CA R88Q)
FRDETRQLCDF

SEQ ID NO: 17069 - protein, 11 aa, Artificial Sequence
  Description of Artificial Sequence: Synthetic peptide
  Seed: FFDETRQLCDL (PIK3CA R88Q)
FRDETRQLCDL

SEQ ID NO: 17070 - protein, 11 aa, Artificial Sequence
  Description of Artificial Sequence: Synthetic peptide
  Seed: FFDETRQLCDL (PIK3CA R88Q)
FRDETRQLCDM

SEQ ID NO: 17071 - protein, 11 aa, Artificial Sequence
  Description of Artificial Sequence: Synthetic peptide
  Seed: FFDETRQLCDL (PIK3CA R88Q)
FRDETRQLCDY

SEQ ID NO: 17072 - protein, 9 aa, Artificial Sequence
  Description of Artificial Sequence: Synthetic peptide
  Seed: FFDETRQLC (PIK3CA R88Q)
FRDETRQLF

SEQ ID NO: 17073 - protein, 9 aa, Artificial Sequence
  Description of Artificial Sequence: Synthetic peptide
  Seed: FFDETRQLC (PIK3CA R88Q)
FRDETRQLH

SEQ ID NO: 17074 - protein, 9 aa, Artificial Sequence
  Description of Artificial Sequence: Synthetic peptide
  Seed: FFDETRQLC (PIK3CA R88Q)
FRDETRQLI

SEQ ID NO: 17075 - protein, 9 aa, Artificial Sequence
  Description of Artificial Sequence: Synthetic peptide
  Seed: FFDETRQLC (PIK3CA R88Q)
FRDETRQLK

SEQ ID NO: 17076 - protein, 9 aa, Artificial Sequence
  Description of Artificial Sequence: Synthetic peptide
  Seed: FFDETRQLC (PIK3CA R88Q)
FRDETRQLL

SEQ ID NO: 17077 - protein, 9 aa, Artificial Sequence
  Description of Artificial Sequence: Synthetic peptide
  Seed: FFDETRQLC (PIK3CA R88Q)
FRDETRQLM

SEQ ID NO: 17078 - protein, 9 aa, Artificial Sequence
  Description of Artificial Sequence: Synthetic peptide
  Seed: FFDETRQLC (PIK3CA R88Q)
FRDETRQLR

SEQ ID NO: 17079 - protein, 9 aa, Artificial Sequence
  Description of Artificial Sequence: Synthetic peptide
  Seed: FFDETRQLC (PIK3CA R88Q)
FRDETRQLS

SEQ ID NO: 17080 - protein, 9 aa, Artificial Sequence
  Description of Artificial Sequence: Synthetic peptide
  Seed: FFDETRQLC (PIK3CA R88Q)
FRDETRQLT

SEQ ID NO: 17081 - protein, 9 aa, Artificial Sequence
  Description of Artificial Sequence: Synthetic peptide
  Seed: FFDETRQLC (PIK3CA R88Q)
FRDETRQLV

SEQ ID NO: 17082 - protein, 9 aa, Artificial Sequence
  Description of Artificial Sequence: Synthetic peptide
  Seed: FFDETRQLC (PIK3CA R88Q)
FRDETRQLW

SEQ ID NO: 17083 - protein, 9 aa, Artificial Sequence
  Description of Artificial Sequence: Synthetic peptide
  Seed: FFDETRQLC (PIK3CA R88Q)
FRDETRQLY

SEQ ID NO: 17084 - protein, 8 aa, Artificial Sequence
  Description of Artificial Sequence: Synthetic peptide
  Seed: FFDETRQL (PIK3CA R88Q)
FRDETRQM

SEQ ID NO: 17085 - protein, 8 aa, Artificial Sequence
  Description of Artificial Sequence: Synthetic peptide
  Seed: FFDETRQL (PIK3CA R88Q)
FRDETRQV

SEQ ID NO: 17086 - protein, 8 aa, Artificial Sequence
  Description of Artificial Sequence: Synthetic peptide
  Seed: FFDETRQL (PIK3CA R88Q)
FRDETRQW

SEQ ID NO: 17087 - protein, 8 aa, Artificial Sequence
  Description of Artificial Sequence: Synthetic peptide
  Seed: FFDETRQL (PIK3CA R88Q)
FRDETRQY

SEQ ID NO: 17088 - protein, 8 aa, Artificial Sequence
  Description of Artificial Sequence: Synthetic peptide
  Seed: FFDETRQL (PIK3CA R88Q)
FSDETRQA

SEQ ID NO: 17089 - protein, 8 aa, Artificial Sequence
  Description of Artificial Sequence: Synthetic peptide
  Seed: FFDETRQL (PIK3CA R88Q)
FSDETRQC

SEQ ID NO: 17090 - protein, 8 aa, Artificial Sequence
  Description of Artificial Sequence: Synthetic peptide
  Seed: FFDETRQL (PIK3CA R88Q)
FSDETRQF

SEQ ID NO: 17091 - protein, 8 aa, Artificial Sequence
  Description of Artificial Sequence: Synthetic peptide
  Seed: FFDETRQL (PIK3CA R88Q)
FSDETRQH

SEQ ID NO: 17092 - protein, 8 aa, Artificial Sequence
  Description of Artificial Sequence: Synthetic peptide
  Seed: FFDETRQL (PIK3CA R88Q)
FSDETRQI

SEQ ID NO: 17093 - protein, 8 aa, Artificial Sequence
  Description of Artificial Sequence: Synthetic peptide
  Seed: FFDETRQL (PIK3CA R88Q)
FSDETRQK

SEQ ID NO: 17094 - protein, 8 aa, Artificial Sequence
  Description of Artificial Sequence: Synthetic peptide
  Seed: FFDETRQL (PIK3CA R88Q)
FSDETRQL

SEQ ID NO: 17095 - protein, 9 aa, Artificial Sequence
  Description of Artificial Sequence: Synthetic peptide
  Seed: FFDETRQLC (PIK3CA R88Q)
FSDETRQLA

SEQ ID NO: 17096 - protein, 9 aa, Artificial Sequence
  Description of Artificial Sequence: Synthetic peptide
  Seed: FFDETRQLC (PIK3CA R88Q)
FSDETRQLC

SEQ ID NO: 17097 - protein, 11 aa, Artificial Sequence
  Description of Artificial Sequence: Synthetic peptide
  Seed: FFDETRQLCDL (PIK3CA R88Q)
FSDETRQLCDC

SEQ ID NO: 17098 - protein, 11 aa, Artificial Sequence
  Description of Artificial Sequence: Synthetic peptide
  Seed: FFDETRQLCDL (PIK3CA R88Q)
FSDETRQLCDF

SEQ ID NO: 17099 - protein, 11 aa, Artificial Sequence
  Description of Artificial Sequence: Synthetic peptide
  Seed: FFDETRQLCDL (PIK3CA R88Q)
FSDETRQLCDI

SEQ ID NO: 17100 - protein, 11 aa, Artificial Sequence
  Description of Artificial Sequence: Synthetic peptide
  Seed: FFDETRQLCDL (PIK3CA R88Q)
FSDETRQLCDL

SEQ ID NO: 17101 - protein, 11 aa, Artificial Sequence
  Description of Artificial Sequence: Synthetic peptide
  Seed: FFDETRQLCDL (PIK3CA R88Q)
FSDETRQLCDM

SEQ ID NO: 17102 - protein, 11 aa, Artificial Sequence
  Description of Artificial Sequence: Synthetic peptide
  Seed: FFDETRQLCDL (PIK3CA R88Q)
FSDETRQLCDV

SEQ ID NO: 17103 - protein, 11 aa, Artificial Sequence
  Description of Artificial Sequence: Synthetic peptide
  Seed: FFDETRQLCDL (PIK3CA R88Q)
FSDETRQLCDW

SEQ ID NO: 17104 - protein, 11 aa, Artificial Sequence
  Description of Artificial Sequence: Synthetic peptide
  Seed: FFDETRQLCDL (PIK3CA R88Q)
FSDETRQLCDY

SEQ ID NO: 17105 - protein, 9 aa, Artificial Sequence
  Description of Artificial Sequence: Synthetic peptide
  Seed: FFDETRQLC (PIK3CA R88Q)
FSDETRQLE

SEQ ID NO: 17106 - protein, 9 aa, Artificial Sequence
  Description of Artificial Sequence: Synthetic peptide
  Seed: FFDETRQLC (PIK3CA R88Q)
FSDETRQLF

SEQ ID NO: 17107 - protein, 9 aa, Artificial Sequence
  Description of Artificial Sequence: Synthetic peptide
  Seed: FFDETRQLC (PIK3CA R88Q)
FSDETRQLG

SEQ ID NO: 17108 - protein, 9 aa, Artificial Sequence
  Description of Artificial Sequence: Synthetic peptide
  Seed: FFDETRQLC (PIK3CA R88Q)
FSDETRQLH

SEQ ID NO: 17109 - protein, 9 aa, Artificial Sequence
  Description of Artificial Sequence: Synthetic peptide
  Seed: FFDETRQLC (PIK3CA R88Q)
FSDETRQLI

SEQ ID NO: 17110 - protein, 9 aa, Artificial Sequence
  Description of Artificial Sequence: Synthetic peptide
  Seed: FFDETRQLC (PIK3CA R88Q)
FSDETRQLK

SEQ ID NO: 17111 - protein, 9 aa, Artificial Sequence
  Description of Artificial Sequence: Synthetic peptide
  Seed: FFDETRQLC (PIK3CA R88Q)
FSDETRQLL

SEQ ID NO: 17112 - protein, 9 aa, Artificial Sequence
  Description of Artificial Sequence: Synthetic peptide
  Seed: FFDETRQLC (PIK3CA R88Q)
FSDETRQLM

SEQ ID NO: 17113 - protein, 9 aa, Artificial Sequence
  Description of Artificial Sequence: Synthetic peptide
  Seed: FFDETRQLC (PIK3CA R88Q)
FSDETRQLN

SEQ ID NO: 17114 - protein, 9 aa, Artificial Sequence
  Description of Artificial Sequence: Synthetic peptide
  Seed: FFDETRQLC (PIK3CA R88Q)
FSDETRQLP

SEQ ID NO: 17115 - protein, 9 aa, Artificial Sequence
  Description of Artificial Sequence: Synthetic peptide
  Seed: FFDETRQLC (PIK3CA R88Q)
FSDETRQLQ

SEQ ID NO: 17116 - protein, 9 aa, Artificial Sequence
  Description of Artificial Sequence: Synthetic peptide
  Seed: FFDETRQLC (PIK3CA R88Q)
FSDETRQLR

SEQ ID NO: 17117 - protein, 9 aa, Artificial Sequence
  Description of Artificial Sequence: Synthetic peptide
  Seed: FFDETRQLC (PIK3CA R88Q)
FSDETRQLS

SEQ ID NO: 17118 - protein, 9 aa, Artificial Sequence
  Description of Artificial Sequence: Synthetic peptide
  Seed: FFDETRQLC (PIK3CA R88Q)
FSDETRQLT

SEQ ID NO: 17119 - protein, 9 aa, Artificial Sequence
  Description of Artificial Sequence: Synthetic peptide
  Seed: FFDETRQLC (PIK3CA R88Q)
FSDETRQLV

SEQ ID NO: 17120 - protein, 9 aa, Artificial Sequence
  Description of Artificial Sequence: Synthetic peptide
  Seed: FFDETRQLC (PIK3CA R88Q)
FSDETRQLW

SEQ ID NO: 17121 - protein, 9 aa, Artificial Sequence
  Description of Artificial Sequence: Synthetic peptide
  Seed: FFDETRQLC (PIK3CA R88Q)
FSDETRQLY

SEQ ID NO: 17122 - protein, 8 aa, Artificial Sequence
  Description of Artificial Sequence: Synthetic peptide
  Seed: FFDETRQL (PIK3CA R88Q)
FSDETRQM

SEQ ID NO: 17123 - protein, 8 aa, Artificial Sequence
  Description of Artificial Sequence: Synthetic peptide
  Seed: FFDETRQL (PIK3CA R88Q)
FSDETRQP

SEQ ID NO: 17124 - protein, 8 aa, Artificial Sequence
  Description of Artificial Sequence: Synthetic peptide
  Seed: FFDETRQL (PIK3CA R88Q)
FSDETRQQ

SEQ ID NO: 17125 - protein, 8 aa, Artificial Sequence
  Description of Artificial Sequence: Synthetic peptide
  Seed: FFDETRQL (PIK3CA R88Q)
FSDETRQR

SEQ ID NO: 17126 - protein, 8 aa, Artificial Sequence
  Description of Artificial Sequence: Synthetic peptide
  Seed: FFDETRQL (PIK3CA R88Q)
FSDETRQS

SEQ ID NO: 17127 - protein, 8 aa, Artificial Sequence
  Description of Artificial Sequence: Synthetic peptide
  Seed: FFDETRQL (PIK3CA R88Q)
FSDETRQT

SEQ ID NO: 17128 - protein, 8 aa, Artificial Sequence
  Description of Artificial Sequence: Synthetic peptide
  Seed: FFDETRQL (PIK3CA R88Q)
FSDETRQV

SEQ ID NO: 17129 - protein, 8 aa, Artificial Sequence
  Description of Artificial Sequence: Synthetic peptide
  Seed: FFDETRQL (PIK3CA R88Q)
FSDETRQW

SEQ ID NO: 17130 - protein, 8 aa, Artificial Sequence
  Description of Artificial Sequence: Synthetic peptide
  Seed: FFDETRQL (PIK3CA R88Q)
FSDETRQY

SEQ ID NO: 17131 - protein, 8 aa, Artificial Sequence
  Description of Artificial Sequence: Synthetic peptide
  Seed: FFDETRQL (PIK3CA R88Q)
FTDETRQA

SEQ ID NO: 17132 - protein, 8 aa, Artificial Sequence
  Description of Artificial Sequence: Synthetic peptide
  Seed: FFDETRQL (PIK3CA R88Q)
FTDETRQC

SEQ ID NO: 17133 - protein, 8 aa, Artificial Sequence
  Description of Artificial Sequence: Synthetic peptide
  Seed: FFDETRQL (PIK3CA R88Q)
FTDETRQF

SEQ ID NO: 17134 - protein, 8 aa, Artificial Sequence
  Description of Artificial Sequence: Synthetic peptide
  Seed: FFDETRQL (PIK3CA R88Q)
FTDETRQI

SEQ ID NO: 17135 - protein, 8 aa, Artificial Sequence
  Description of Artificial Sequence: Synthetic peptide
  Seed: FFDETRQL (PIK3CA R88Q)
FTDETRQK

SEQ ID NO: 17136 - protein, 8 aa, Artificial Sequence
  Description of Artificial Sequence: Synthetic peptide
  Seed: FFDETRQL (PIK3CA R88Q)
FTDETRQL

SEQ ID NO: 17137 - protein, 9 aa, Artificial Sequence
  Description of Artificial Sequence: Synthetic peptide
  Seed: FFDETRQLC (PIK3CA R88Q)
FTDETRQLA

SEQ ID NO: 17138 - protein, 9 aa, Artificial Sequence
  Description of Artificial Sequence: Synthetic peptide
  Seed: FFDETRQLC (PIK3CA R88Q)
FTDETRQLC

SEQ ID NO: 17139 - protein, 11 aa, Artificial Sequence
  Description of Artificial Sequence: Synthetic peptide
  Seed: FFDETRQLCDL (PIK3CA R88Q)
FTDETRQLCDC

SEQ ID NO: 17140 - protein, 11 aa, Artificial Sequence
  Description of Artificial Sequence: Synthetic peptide
  Seed: FFDETRQLCDL (PIK3CA R88Q)
FTDETRQLCDF

SEQ ID NO: 17141 - protein, 11 aa, Artificial Sequence
  Description of Artificial Sequence: Synthetic peptide
  Seed: FFDETRQLCDL (PIK3CA R88Q)
FTDETRQLCDI

SEQ ID NO: 17142 - protein, 11 aa, Artificial Sequence
  Description of Artificial Sequence: Synthetic peptide
  Seed: FFDETRQLCDL (PIK3CA R88Q)
FTDETRQLCDL

SEQ ID NO: 17143 - protein, 11 aa, Artificial Sequence
  Description of Artificial Sequence: Synthetic peptide
  Seed: FFDETRQLCDL (PIK3CA R88Q)
FTDETRQLCDM

SEQ ID NO: 17144 - protein, 11 aa, Artificial Sequence
  Description of Artificial Sequence: Synthetic peptide
  Seed: FFDETRQLCDL (PIK3CA R88Q)
FTDETRQLCDV

SEQ ID NO: 17145 - protein, 11 aa, Artificial Sequence
  Description of Artificial Sequence: Synthetic peptide
  Seed: FFDETRQLCDL (PIK3CA R88Q)
FTDETRQLCDW

SEQ ID NO: 17146 - protein, 11 aa, Artificial Sequence
  Description of Artificial Sequence: Synthetic peptide
  Seed: FFDETRQLCDL (PIK3CA R88Q)
FTDETRQLCDY

SEQ ID NO: 17147 - protein, 9 aa, Artificial Sequence
  Description of Artificial Sequence: Synthetic peptide
  Seed: FFDETRQLC (PIK3CA R88Q)
FTDETRQLE

SEQ ID NO: 17148 - protein, 9 aa, Artificial Sequence
  Description of Artificial Sequence: Synthetic peptide
  Seed: FFDETRQLC (PIK3CA R88Q)
FTDETRQLF

SEQ ID NO: 17149 - protein, 9 aa, Artificial Sequence
  Description of Artificial Sequence: Synthetic peptide
  Seed: FFDETRQLC (PIK3CA R88Q)
FTDETRQLG

SEQ ID NO: 17150 - protein, 9 aa, Artificial Sequence
  Description of Artificial Sequence: Synthetic peptide
  Seed: FFDETRQLC (PIK3CA R88Q)
FTDETRQLH

SEQ ID NO: 17151 - protein, 9 aa, Artificial Sequence
  Description of Artificial Sequence: Synthetic peptide
  Seed: FFDETRQLC (PIK3CA R88Q)
FTDETRQLI

SEQ ID NO: 17152 - protein, 9 aa, Artificial Sequence
  Description of Artificial Sequence: Synthetic peptide
  Seed: FFDETRQLC (PIK3CA R88Q)
FTDETRQLK

SEQ ID NO: 17153 - protein, 9 aa, Artificial Sequence
  Description of Artificial Sequence: Synthetic peptide
  Seed: FFDETRQLC (PIK3CA R88Q)
FTDETRQLL

SEQ ID NO: 17154 - protein, 9 aa, Artificial Sequence
  Description of Artificial Sequence: Synthetic peptide
  Seed: FFDETRQLC (PIK3CA R88Q)
FTDETRQLM

SEQ ID NO: 17155 - protein, 9 aa, Artificial Sequence
  Description of Artificial Sequence: Synthetic peptide
  Seed: FFDETRQLC (PIK3CA R88Q)
FTDETRQLN

SEQ ID NO: 17156 - protein, 9 aa, Artificial Sequence
  Description of Artificial Sequence: Synthetic peptide
  Seed: FFDETRQLC (PIK3CA R88Q)
FTDETRQLP

SEQ ID NO: 17157 - protein, 9 aa, Artificial Sequence
  Description of Artificial Sequence: Synthetic peptide
  Seed: FFDETRQLC (PIK3CA R88Q)
FTDETRQLQ

SEQ ID NO: 17158 - protein, 9 aa, Artificial Sequence
  Description of Artificial Sequence: Synthetic peptide
  Seed: FFDETRQLC (PIK3CA R88Q)
FTDETRQLR

SEQ ID NO: 17159 - protein, 9 aa, Artificial Sequence
  Description of Artificial Sequence: Synthetic peptide
  Seed: FFDETRQLC (PIK3CA R88Q)
FTDETRQLS

SEQ ID NO: 17160 - protein, 9 aa, Artificial Sequence
  Description of Artificial Sequence: Synthetic peptide
  Seed: FFDETRQLC (PIK3CA R88Q)
FTDETRQLT

SEQ ID NO: 17161 - protein, 9 aa, Artificial Sequence
  Description of Artificial Sequence: Synthetic peptide
  Seed: FFDETRQLC (PIK3CA R88Q)
FTDETRQLV

SEQ ID NO: 17162 - protein, 9 aa, Artificial Sequence
  Description of Artificial Sequence: Synthetic peptide
  Seed: FFDETRQLC (PIK3CA R88Q)
FTDETRQLW

SEQ ID NO: 17163 - protein, 9 aa, Artificial Sequence
  Description of Artificial Sequence: Synthetic peptide
  Seed: FFDETRQLC (PIK3CA R88Q)
FTDETRQLY

SEQ ID NO: 17164 - protein, 8 aa, Artificial Sequence
  Description of Artificial Sequence: Synthetic peptide
  Seed: FFDETRQL (PIK3CA R88Q)
FTDETRQM

SEQ ID NO: 17165 - protein, 8 aa, Artificial Sequence
  Description of Artificial Sequence: Synthetic peptide
  Seed: FFDETRQL (PIK3CA R88Q)
FTDETRQQ

SEQ ID NO: 17166 - protein, 8 aa, Artificial Sequence
  Description of Artificial Sequence: Synthetic peptide
  Seed: FFDETRQL (PIK3CA R88Q)
FTDETRQR

SEQ ID NO: 17167 - protein, 8 aa, Artificial Sequence
  Description of Artificial Sequence: Synthetic peptide
  Seed: FFDETRQL (PIK3CA R88Q)
FTDETRQS

SEQ ID NO: 17168 - protein, 8 aa, Artificial Sequence
  Description of Artificial Sequence: Synthetic peptide
  Seed: FFDETRQL (PIK3CA R88Q)
FTDETRQT

SEQ ID NO: 17169 - protein, 8 aa, Artificial Sequence
  Description of Artificial Sequence: Synthetic peptide
  Seed: FFDETRQL (PIK3CA R88Q)
FTDETRQV

SEQ ID NO: 17170 - protein, 8 aa, Artificial Sequence
  Description of Artificial Sequence: Synthetic peptide
  Seed: FFDETRQL (PIK3CA R88Q)
FTDETRQW

SEQ ID NO: 17171 - protein, 8 aa, Artificial Sequence
  Description of Artificial Sequence: Synthetic peptide
  Seed: FFDETRQL (PIK3CA R88Q)
FTDETRQY

SEQ ID NO: 17172 - protein, 8 aa, Artificial Sequence
  Description of Artificial Sequence: Synthetic peptide
  Seed: FFDETRQL (PIK3CA R88Q)
FVDETRQA

SEQ ID NO: 17173 - protein, 8 aa, Artificial Sequence
  Description of Artificial Sequence: Synthetic peptide
  Seed: FFDETRQL (PIK3CA R88Q)
FVDETRQC

SEQ ID NO: 17174 - protein, 8 aa, Artificial Sequence
  Description of Artificial Sequence: Synthetic peptide
  Seed: FFDETRQL (PIK3CA R88Q)
FVDETRQF

SEQ ID NO: 17175 - protein, 8 aa, Artificial Sequence
  Description of Artificial Sequence: Synthetic peptide
  Seed: FFDETRQL (PIK3CA R88Q)
FVDETRQH

SEQ ID NO: 17176 - protein, 8 aa, Artificial Sequence
  Description of Artificial Sequence: Synthetic peptide
  Seed: FFDETRQL (PIK3CA R88Q)
FVDETRQI

SEQ ID NO: 17177 - protein, 8 aa, Artificial Sequence
  Description of Artificial Sequence: Synthetic peptide
  Seed: FFDETRQL (PIK3CA R88Q)
FVDETRQK

SEQ ID NO: 17178 - protein, 8 aa, Artificial Sequence
  Description of Artificial Sequence: Synthetic peptide
  Seed: FFDETRQL (PIK3CA R88Q)
FVDETRQL

SEQ ID NO: 17179 - protein, 9 aa, Artificial Sequence
  Description of Artificial Sequence: Synthetic peptide
  Seed: FFDETRQLC (PIK3CA R88Q)
FVDETRQLA

SEQ ID NO: 17180 - protein, 9 aa, Artificial Sequence
  Description of Artificial Sequence: Synthetic peptide
  Seed: FFDETRQLC (PIK3CA R88Q)
FVDETRQLC

SEQ ID NO: 17181 - protein, 11 aa, Artificial Sequence
  Description of Artificial Sequence: Synthetic peptide
  Seed: FFDETRQLCDL (PIK3CA R88Q)
FVDETRQLCDC

SEQ ID NO: 17182 - protein, 11 aa, Artificial Sequence
  Description of Artificial Sequence: Synthetic peptide
  Seed: FFDETRQLCDL (PIK3CA R88Q)
FVDETRQLCDF

SEQ ID NO: 17183 - protein, 11 aa, Artificial Sequence
  Description of Artificial Sequence: Synthetic peptide
  Seed: FFDETRQLCDL (PIK3CA R88Q)
FVDETRQLCDI

SEQ ID NO: 17184 - protein, 11 aa, Artificial Sequence
  Description of Artificial Sequence: Synthetic peptide
  Seed: FFDETRQLCDL (PIK3CA R88Q)
FVDETRQLCDL

SEQ ID NO: 17185 - protein, 11 aa, Artificial Sequence
  Description of Artificial Sequence: Synthetic peptide
  Seed: FFDETRQLCDL (PIK3CA R88Q)
FVDETRQLCDM

SEQ ID NO: 17186 - protein, 11 aa, Artificial Sequence
  Description of Artificial Sequence: Synthetic peptide
  Seed: FFDETRQLCDL (PIK3CA R88Q)
FVDETRQLCDV

SEQ ID NO: 17187 - protein, 11 aa, Artificial Sequence
  Description of Artificial Sequence: Synthetic peptide
  Seed: FFDETRQLCDL (PIK3CA R88Q)
FVDETRQLCDW

SEQ ID NO: 17188 - protein, 11 aa, Artificial Sequence
  Description of Artificial Sequence: Synthetic peptide
  Seed: FFDETRQLCDL (PIK3CA R88Q)
FVDETRQLCDY

SEQ ID NO: 17189 - protein, 9 aa, Artificial Sequence
  Description of Artificial Sequence: Synthetic peptide
  Seed: FFDETRQLC (PIK3CA R88Q)
FVDETRQLE

SEQ ID NO: 17190 - protein, 9 aa, Artificial Sequence
  Description of Artificial Sequence: Synthetic peptide
  Seed: FFDETRQLC (PIK3CA R88Q)
FVDETRQLF

SEQ ID NO: 17191 - protein, 9 aa, Artificial Sequence
  Description of Artificial Sequence: Synthetic peptide
  Seed: FFDETRQLC (PIK3CA R88Q)
FVDETRQLG

SEQ ID NO: 17192 - protein, 9 aa, Artificial Sequence
  Description of Artificial Sequence: Synthetic peptide
  Seed: FFDETRQLC (PIK3CA R88Q)
FVDETRQLH

SEQ ID NO: 17193 - protein, 9 aa, Artificial Sequence
  Description of Artificial Sequence: Synthetic peptide
  Seed: FFDETRQLC (PIK3CA R88Q)
FVDETRQLI

SEQ ID NO: 17194 - protein, 9 aa, Artificial Sequence
  Description of Artificial Sequence: Synthetic peptide
  Seed: FFDETRQLC (PIK3CA R88Q)
FVDETRQLK

SEQ ID NO: 17195 - protein, 9 aa, Artificial Sequence
  Description of Artificial Sequence: Synthetic peptide
  Seed: FFDETRQLC (PIK3CA R88Q)
FVDETRQLL

SEQ ID NO: 17196 - protein, 9 aa, Artificial Sequence
  Description of Artificial Sequence: Synthetic peptide
  Seed: FFDETRQLC (PIK3CA R88Q)
FVDETRQLM

SEQ ID NO: 17197 - protein, 9 aa, Artificial Sequence
  Description of Artificial Sequence: Synthetic peptide
  Seed: FFDETRQLC (PIK3CA R88Q)
FVDETRQLN

SEQ ID NO: 17198 - protein, 9 aa, Artificial Sequence
  Description of Artificial Sequence: Synthetic peptide
  Seed: FFDETRQLC (PIK3CA R88Q)
FVDETRQLP

SEQ ID NO: 17199 - protein, 9 aa, Artificial Sequence
  Description of Artificial Sequence: Synthetic peptide
  Seed: FFDETRQLC (PIK3CA R88Q)
FVDETRQLQ

SEQ ID NO: 17200 - protein, 9 aa, Artificial Sequence
  Description of Artificial Sequence: Synthetic peptide
  Seed: FFDETRQLC (PIK3CA R88Q)
FVDETRQLR

SEQ ID NO: 17201 - protein, 9 aa, Artificial Sequence
  Description of Artificial Sequence: Synthetic peptide
  Seed: FFDETRQLC (PIK3CA R88Q)
FVDETRQLS

SEQ ID NO: 17202 - protein, 9 aa, Artificial Sequence
  Description of Artificial Sequence: Synthetic peptide
  Seed: FFDETRQLC (PIK3CA R88Q)
FVDETRQLT

SEQ ID NO: 17203 - protein, 9 aa, Artificial Sequence
  Description of Artificial Sequence: Synthetic peptide
  Seed: FFDETRQLC (PIK3CA R88Q)
FVDETRQLV

SEQ ID NO: 17204 - protein, 9 aa, Artificial Sequence
  Description of Artificial Sequence: Synthetic peptide
  Seed: FFDETRQLC (PIK3CA R88Q)
FVDETRQLW

SEQ ID NO: 17205 - protein, 9 aa, Artificial Sequence
  Description of Artificial Sequence: Synthetic peptide
  Seed: FFDETRQLC (PIK3CA R88Q)
FVDETRQLY

SEQ ID NO: 17206 - protein, 8 aa, Artificial Sequence
  Description of Artificial Sequence: Synthetic peptide
  Seed: FFDETRQL (PIK3CA R88Q)
FVDETRQM

SEQ ID NO: 17207 - protein, 8 aa, Artificial Sequence
  Description of Artificial Sequence: Synthetic peptide
  Seed: FFDETRQL (PIK3CA R88Q)
FVDETRQQ

SEQ ID NO: 17208 - protein, 8 aa, Artificial Sequence
  Description of Artificial Sequence: Synthetic peptide
  Seed: FFDETRQL (PIK3CA R88Q)
FVDETRQR

SEQ ID NO: 17209 - protein, 8 aa, Artificial Sequence
  Description of Artificial Sequence: Synthetic peptide
  Seed: FFDETRQL (PIK3CA R88Q)
FVDETRQT

SEQ ID NO: 17210 - protein, 8 aa, Artificial Sequence
  Description of Artificial Sequence: Synthetic peptide
  Seed: FFDETRQL (PIK3CA R88Q)
FVDETRQV

SEQ ID NO: 17211 - protein, 8 aa, Artificial Sequence
  Description of Artificial Sequence: Synthetic peptide
  Seed: FFDETRQL (PIK3CA R88Q)
FVDETRQW

SEQ ID NO: 17212 - protein, 8 aa, Artificial Sequence
  Description of Artificial Sequence: Synthetic peptide
  Seed: FFDETRQL (PIK3CA R88Q)
FVDETRQY

SEQ ID NO: 17213 - protein, 8 aa, Artificial Sequence
  Description of Artificial Sequence: Synthetic peptide
  Seed: FFDETRQL (PIK3CA R88Q)
FWDETRQA

SEQ ID NO: 17214 - protein, 8 aa, Artificial Sequence
  Description of Artificial Sequence: Synthetic peptide
  Seed: FFDETRQL (PIK3CA R88Q)
FWDETRQC

SEQ ID NO: 17215 - protein, 8 aa, Artificial Sequence
  Description of Artificial Sequence: Synthetic peptide
  Seed: FFDETRQL (PIK3CA R88Q)
FWDETRQI

SEQ ID NO: 17216 - protein, 9 aa, Artificial Sequence
  Description of Artificial Sequence: Synthetic peptide
  Seed: FFDETRQLC (PIK3CA R88Q)
FWDETRQLA

SEQ ID NO: 17217 - protein, 9 aa, Artificial Sequence
  Description of Artificial Sequence: Synthetic peptide
  Seed: FFDETRQLC (PIK3CA R88Q)
FWDETRQLC

SEQ ID NO: 17218 - protein, 11 aa, Artificial Sequence
  Description of Artificial Sequence: Synthetic peptide
  Seed: FFDETRQLCDL (PIK3CA R88Q)
FWDETRQLCDC

SEQ ID NO: 17219 - protein, 11 aa, Artificial Sequence
  Description of Artificial Sequence: Synthetic peptide
  Seed: FFDETRQLCDL (PIK3CA R88Q)
FWDETRQLCDF

SEQ ID NO: 17220 - protein, 11 aa, Artificial Sequence
  Description of Artificial Sequence: Synthetic peptide
  Seed: FFDETRQLCDL (PIK3CA R88Q)
FWDETRQLCDI

SEQ ID NO: 17221 - protein, 11 aa, Artificial Sequence
  Description of Artificial Sequence: Synthetic peptide
  Seed: FFDETRQLCDL (PIK3CA R88Q)
FWDETRQLCDL

SEQ ID NO: 17222 - protein, 11 aa, Artificial Sequence
  Description of Artificial Sequence: Synthetic peptide
  Seed: FFDETRQLCDL (PIK3CA R88Q)
FWDETRQLCDM

SEQ ID NO: 17223 - protein, 11 aa, Artificial Sequence
  Description of Artificial Sequence: Synthetic peptide
  Seed: FFDETRQLCDL (PIK3CA R88Q)
FWDETRQLCDV

SEQ ID NO: 17224 - protein, 11 aa, Artificial Sequence
  Description of Artificial Sequence: Synthetic peptide
  Seed: FFDETRQLCDL (PIK3CA R88Q)
FWDETRQLCDW

SEQ ID NO: 17225 - protein, 11 aa, Artificial Sequence
  Description of Artificial Sequence: Synthetic peptide
  Seed: FFDETRQLCDL (PIK3CA R88Q)
FWDETRQLCDY

SEQ ID NO: 17226 - protein, 9 aa, Artificial Sequence
  Description of Artificial Sequence: Synthetic peptide
  Seed: FFDETRQLC (PIK3CA R88Q)
FWDETRQLE

SEQ ID NO: 17227 - protein, 9 aa, Artificial Sequence
  Description of Artificial Sequence: Synthetic peptide
  Seed: FFDETRQLC (PIK3CA R88Q)
FWDETRQLF

SEQ ID NO: 17228 - protein, 9 aa, Artificial Sequence
  Description of Artificial Sequence: Synthetic peptide
  Seed: FFDETRQLC (PIK3CA R88Q)
FWDETRQLG

SEQ ID NO: 17229 - protein, 9 aa, Artificial Sequence
  Description of Artificial Sequence: Synthetic peptide
  Seed: FFDETRQLC (PIK3CA R88Q)
FWDETRQLH

SEQ ID NO: 17230 - protein, 9 aa, Artificial Sequence
  Description of Artificial Sequence: Synthetic peptide
  Seed: FFDETRQLC (PIK3CA R88Q)
FWDETRQLI

SEQ ID NO: 17231 - protein, 9 aa, Artificial Sequence
  Description of Artificial Sequence: Synthetic peptide
  Seed: FFDETRQLC (PIK3CA R88Q)
FWDETRQLK

SEQ ID NO: 17232 - protein, 9 aa, Artificial Sequence
  Description of Artificial Sequence: Synthetic peptide
  Seed: FFDETRQLC (PIK3CA R88Q)
FWDETRQLL

SEQ ID NO: 17233 - protein, 9 aa, Artificial Sequence
  Description of Artificial Sequence: Synthetic peptide
  Seed: FFDETRQLC (PIK3CA R88Q)
FWDETRQLM

SEQ ID NO: 17234 - protein, 9 aa, Artificial Sequence
  Description of Artificial Sequence: Synthetic peptide
  Seed: FFDETRQLC (PIK3CA R88Q)
FWDETRQLN

SEQ ID NO: 17235 - protein, 9 aa, Artificial Sequence
  Description of Artificial Sequence: Synthetic peptide
  Seed: FFDETRQLC (PIK3CA R88Q)
FWDETRQLP

SEQ ID NO: 17236 - protein, 9 aa, Artificial Sequence
  Description of Artificial Sequence: Synthetic peptide
  Seed: FFDETRQLC (PIK3CA R88Q)
FWDETRQLQ

SEQ ID NO: 17237 - protein, 9 aa, Artificial Sequence
  Description of Artificial Sequence: Synthetic peptide
  Seed: FFDETRQLC (PIK3CA R88Q)
FWDETRQLR

SEQ ID NO: 17238 - protein, 9 aa, Artificial Sequence
  Description of Artificial Sequence: Synthetic peptide
  Seed: FFDETRQLC (PIK3CA R88Q)
FWDETRQLS

SEQ ID NO: 17239 - protein, 9 aa, Artificial Sequence
  Description of Artificial Sequence: Synthetic peptide
  Seed: FFDETRQLC (PIK3CA R88Q)
FWDETRQLT

SEQ ID NO: 17240 - protein, 9 aa, Artificial Sequence
  Description of Artificial Sequence: Synthetic peptide
  Seed: FFDETRQLC (PIK3CA R88Q)
FWDETRQLV

SEQ ID NO: 17241 - protein, 9 aa, Artificial Sequence
  Description of Artificial Sequence: Synthetic peptide
  Seed: FFDETRQLC (PIK3CA R88Q)
FWDETRQLW

SEQ ID NO: 17242 - protein, 9 aa, Artificial Sequence
  Description of Artificial Sequence: Synthetic peptide
  Seed: FFDETRQLC (PIK3CA R88Q)
FWDETRQLY

SEQ ID NO: 17243 - protein, 8 aa, Artificial Sequence
  Description of Artificial Sequence: Synthetic peptide
  Seed: FFDETRQL (PIK3CA R88Q)
FWDETRQT

SEQ ID NO: 17244 - protein, 8 aa, Artificial Sequence
  Description of Artificial Sequence: Synthetic peptide
  Seed: FFDETRQL (PIK3CA R88Q)
FWDETRQV

SEQ ID NO: 17245 - protein, 8 aa, Artificial Sequence
  Description of Artificial Sequence: Synthetic peptide
  Seed: FFDETRQL (PIK3CA R88Q)
FWDETRQW

SEQ ID NO: 17246 - protein, 8 aa, Artificial Sequence
  Description of Artificial Sequence: Synthetic peptide
  Seed: FFDETRQL (PIK3CA R88Q)
FYDETRQA

SEQ ID NO: 17247 - protein, 8 aa, Artificial Sequence
  Description of Artificial Sequence: Synthetic peptide
  Seed: FFDETRQL (PIK3CA R88Q)
FYDETRQC

SEQ ID NO: 17248 - protein, 8 aa, Artificial Sequence
  Description of Artificial Sequence: Synthetic peptide
  Seed: FFDETRQL (PIK3CA R88Q)
FYDETRQH

SEQ ID NO: 17249 - protein, 8 aa, Artificial Sequence
  Description of Artificial Sequence: Synthetic peptide
  Seed: FFDETRQL (PIK3CA R88Q)
FYDETRQK

SEQ ID NO: 17250 - protein, 9 aa, Artificial Sequence
  Description of Artificial Sequence: Synthetic peptide
  Seed: FFDETRQLC (PIK3CA R88Q)
FYDETRQLA

SEQ ID NO: 17251 - protein, 9 aa, Artificial Sequence
  Description of Artificial Sequence: Synthetic peptide
  Seed: FFDETRQLC (PIK3CA R88Q)
FYDETRQLC

SEQ ID NO: 17252 - protein, 11 aa, Artificial Sequence
  Description of Artificial Sequence: Synthetic peptide
  Seed: FFDETRQLCDL (PIK3CA R88Q)
FYDETRQLCDC

SEQ ID NO: 17253 - protein, 11 aa, Artificial Sequence
  Description of Artificial Sequence: Synthetic peptide
  Seed: FFDETRQLCDL (PIK3CA R88Q)
FYDETRQLCDF

SEQ ID NO: 17254 - protein, 11 aa, Artificial Sequence
  Description of Artificial Sequence: Synthetic peptide
  Seed: FFDETRQLCDL (PIK3CA R88Q)
FYDETRQLCDI

SEQ ID NO: 17255 - protein, 11 aa, Artificial Sequence
  Description of Artificial Sequence: Synthetic peptide
  Seed: FFDETRQLCDL (PIK3CA R88Q)
FYDETRQLCDL

SEQ ID NO: 17256 - protein, 11 aa, Artificial Sequence
  Description of Artificial Sequence: Synthetic peptide
  Seed: FFDETRQLCDL (PIK3CA R88Q)
FYDETRQLCDM

SEQ ID NO: 17257 - protein, 11 aa, Artificial Sequence
  Description of Artificial Sequence: Synthetic peptide
  Seed: FFDETRQLCDL (PIK3CA R88Q)
FYDETRQLCDV

SEQ ID NO: 17258 - protein, 11 aa, Artificial Sequence
  Description of Artificial Sequence: Synthetic peptide
  Seed: FFDETRQLCDL (PIK3CA R88Q)
FYDETRQLCDW

SEQ ID NO: 17259 - protein, 11 aa, Artificial Sequence
  Description of Artificial Sequence: Synthetic peptide
  Seed: FFDETRQLCDL (PIK3CA R88Q)
FYDETRQLCDY

SEQ ID NO: 17260 - protein, 9 aa, Artificial Sequence
  Description of Artificial Sequence: Synthetic peptide
  Seed: FFDETRQLC (PIK3CA R88Q)
FYDETRQLD

SEQ ID NO: 17261 - protein, 9 aa, Artificial Sequence
  Description of Artificial Sequence: Synthetic peptide
  Seed: FFDETRQLC (PIK3CA R88Q)
FYDETRQLE

SEQ ID NO: 17262 - protein, 9 aa, Artificial Sequence
  Description of Artificial Sequence: Synthetic peptide
  Seed: FFDETRQLC (PIK3CA R88Q)
FYDETRQLF

SEQ ID NO: 17263 - protein, 9 aa, Artificial Sequence
  Description of Artificial Sequence: Synthetic peptide
  Seed: FFDETRQLC (PIK3CA R88Q)
FYDETRQLG

SEQ ID NO: 17264 - protein, 9 aa, Artificial Sequence
  Description of Artificial Sequence: Synthetic peptide
  Seed: FFDETRQLC (PIK3CA R88Q)
FYDETRQLH

SEQ ID NO: 17265 - protein, 9 aa, Artificial Sequence
  Description of Artificial Sequence: Synthetic peptide
  Seed: FFDETRQLC (PIK3CA R88Q)
FYDETRQLI

SEQ ID NO: 17266 - protein, 9 aa, Artificial Sequence
  Description of Artificial Sequence: Synthetic peptide
  Seed: FFDETRQLC (PIK3CA R88Q)
FYDETRQLK

SEQ ID NO: 17267 - protein, 9 aa, Artificial Sequence
  Description of Artificial Sequence: Synthetic peptide
  Seed: FFDETRQLC (PIK3CA R88Q)
FYDETRQLL

SEQ ID NO: 17268 - protein, 9 aa, Artificial Sequence
  Description of Artificial Sequence: Synthetic peptide
  Seed: FFDETRQLC (PIK3CA R88Q)
FYDETRQLN

SEQ ID NO: 17269 - protein, 9 aa, Artificial Sequence
  Description of Artificial Sequence: Synthetic peptide
  Seed: FFDETRQLC (PIK3CA R88Q)
FYDETRQLP

SEQ ID NO: 17270 - protein, 9 aa, Artificial Sequence
  Description of Artificial Sequence: Synthetic peptide
  Seed: FFDETRQLC (PIK3CA R88Q)
FYDETRQLQ

SEQ ID NO: 17271 - protein, 9 aa, Artificial Sequence
  Description of Artificial Sequence: Synthetic peptide
  Seed: FFDETRQLC (PIK3CA R88Q)
FYDETRQLR

SEQ ID NO: 17272 - protein, 9 aa, Artificial Sequence
  Description of Artificial Sequence: Synthetic peptide
  Seed: FFDETRQLC (PIK3CA R88Q)
FYDETRQLS

SEQ ID NO: 17273 - protein, 9 aa, Artificial Sequence
  Description of Artificial Sequence: Synthetic peptide
  Seed: FFDETRQLC (PIK3CA R88Q)
FYDETRQLT

SEQ ID NO: 17274 - protein, 9 aa, Artificial Sequence
  Description of Artificial Sequence: Synthetic peptide
  Seed: FFDETRQLC (PIK3CA R88Q)
FYDETRQLV

SEQ ID NO: 17275 - protein, 9 aa, Artificial Sequence
  Description of Artificial Sequence: Synthetic peptide
  Seed: FFDETRQLC (PIK3CA R88Q)
FYDETRQLW

SEQ ID NO: 17276 - protein, 9 aa, Artificial Sequence
  Description of Artificial Sequence: Synthetic peptide
  Seed: FFDETRQLC (PIK3CA R88Q)
FYDETRQLY

SEQ ID NO: 17277 - protein, 8 aa, Artificial Sequence
  Description of Artificial Sequence: Synthetic peptide
  Seed: FFDETRQL (PIK3CA R88Q)
FYDETRQQ

SEQ ID NO: 17278 - protein, 8 aa, Artificial Sequence
  Description of Artificial Sequence: Synthetic peptide
  Seed: FFDETRQL (PIK3CA R88Q)
FYDETRQR

SEQ ID NO: 17279 - protein, 8 aa, Artificial Sequence
  Description of Artificial Sequence: Synthetic peptide
  Seed: FFDETRQL (PIK3CA R88Q)
FYDETRQT

SEQ ID NO: 17280 - protein, 8 aa, Artificial Sequence
  Description of Artificial Sequence: Synthetic peptide
  Seed: FFDETRQL (PIK3CA R88Q)
FYDETRQW

SEQ ID NO: 17281 - protein, 11 aa, Artificial Sequence
  Description of Artificial Sequence: Synthetic peptide
  Seed: REEFFDETRQL (PIK3CA R88Q)
RDEFFDETRQF

SEQ ID NO: 17282 - protein, 11 aa, Artificial Sequence
  Description of Artificial Sequence: Synthetic peptide
  Seed: REEFFDETRQL (PIK3CA R88Q)
RDEFFDETRQL

SEQ ID NO: 17283 - protein, 11 aa, Artificial Sequence
  Description of Artificial Sequence: Synthetic peptide
  Seed: REEFFDETRQL (PIK3CA R88Q)
RDEFFDETRQM

SEQ ID NO: 17284 - protein, 11 aa, Artificial Sequence
  Description of Artificial Sequence: Synthetic peptide
  Seed: REEFFDETRQL (PIK3CA R88Q)
RDEFFDETRQW

SEQ ID NO: 17285 - protein, 11 aa, Artificial Sequence
  Description of Artificial Sequence: Synthetic peptide
  Seed: REEFFDETRQL (PIK3CA R88Q)
RDEFFDETRQY

SEQ ID NO: 17286 - protein, 11 aa, Artificial Sequence
  Description of Artificial Sequence: Synthetic peptide
  Seed: REEFFDETRQL (PIK3CA R88Q)
REEFFDETRQA

SEQ ID NO: 17287 - protein, 11 aa, Artificial Sequence
  Description of Artificial Sequence: Synthetic peptide
  Seed: REEFFDETRQL (PIK3CA R88Q)
REEFFDETRQC

SEQ ID NO: 17288 - protein, 11 aa, Artificial Sequence
  Description of Artificial Sequence: Synthetic peptide
  Seed: REEFFDETRQL (PIK3CA R88Q)
REEFFDETRQF

SEQ ID NO: 17289 - protein, 11 aa, Artificial Sequence
  Description of Artificial Sequence: Synthetic peptide
  Seed: REEFFDETRQL (PIK3CA R88Q)
REEFFDETRQG

SEQ ID NO: 17290 - protein, 11 aa, Artificial Sequence
  Description of Artificial Sequence: Synthetic peptide
  Seed: REEFFDETRQL (PIK3CA R88Q)
REEFFDETRQH

SEQ ID NO: 17291 - protein, 11 aa, Artificial Sequence
  Description of Artificial Sequence: Synthetic peptide
  Seed: REEFFDETRQL (PIK3CA R88Q)
REEFFDETRQP

SEQ ID NO: 17292 - protein, 11 aa, Artificial Sequence
  Description of Artificial Sequence: Synthetic peptide
  Seed: REEFFDETRQL (PIK3CA R88Q)
REEFFDETRQS

SEQ ID NO: 17293 - protein, 11 aa, Artificial Sequence
  Description of Artificial Sequence: Synthetic peptide
  Seed: REEFFDETRQL (PIK3CA R88Q)
REEFFDETRQT

SEQ ID NO: 17294 - protein, 11 aa, Artificial Sequence
  Description of Artificial Sequence: Synthetic peptide
  Seed: REEFFDETRQL (PIK3CA R88Q)
REEFFDETRQW

SEQ ID NO: 17295 - protein, 11 aa, Artificial Sequence
  Description of Artificial Sequence: Synthetic peptide
  Seed: REEFFDETRQL (PIK3CA R88Q)
REEFFDETRQY

SEQ ID NO: 17296 - protein, 11 aa, Artificial Sequence
  Description of Artificial Sequence: Synthetic peptide
  Seed: REEFFDETRQL (PIK3CA R88Q)
RHEFFDETRQW

SEQ ID NO: 17297 - protein, 11 aa, Artificial Sequence
  Description of Artificial Sequence: Synthetic peptide
  Seed: REEFFDETRQL (PIK3CA R88Q)
RKEFFDETRQW

SEQ ID NO: 17298 - protein, 11 aa, Artificial Sequence
  Description of Artificial Sequence: Synthetic peptide
  Seed: REEFFDETRQL (PIK3CA R88Q)
RQEFFDETRQF

SEQ ID NO: 17299 - protein, 11 aa, Artificial Sequence
  Description of Artificial Sequence: Synthetic peptide
  Seed: REEFFDETRQL (PIK3CA R88Q)
RQEFFDETRQL

SEQ ID NO: 17300 - protein, 11 aa, Artificial Sequence
  Description of Artificial Sequence: Synthetic peptide
  Seed: REEFFDETRQL (PIK3CA R88Q)
RQEFFDETRQM

SEQ ID NO: 17301 - protein, 11 aa, Artificial Sequence
  Description of Artificial Sequence: Synthetic peptide
  Seed: REEFFDETRQL (PIK3CA R88Q)
RQEFFDETRQW

SEQ ID NO: 17302 - protein, 11 aa, Artificial Sequence
  Description of Artificial Sequence: Synthetic peptide
  Seed: REEFFDETRQL (PIK3CA R88Q)
RQEFFDETRQY

SEQ ID NO: 17303 - protein, 9 aa, Artificial Sequence
  Description of Artificial Sequence: Synthetic peptide
  Seed: TRQLCDLRL (PIK3CA R88Q)
TAQLCDLRL

SEQ ID NO: 17304 - protein, 9 aa, Artificial Sequence
  Description of Artificial Sequence: Synthetic peptide
  Seed: TRQLCDLRL (PIK3CA R88Q)
TFQLCDLRF

SEQ ID NO: 17305 - protein, 9 aa, Artificial Sequence
  Description of Artificial Sequence: Synthetic peptide
  Seed: TRQLCDLRL (PIK3CA R88Q)
TFQLCDLRL

SEQ ID NO: 17306 - protein, 9 aa, Artificial Sequence
  Description of Artificial Sequence: Synthetic peptide
  Seed: TRQLCDLRL (PIK3CA R88Q)
TFQLCDLRM

SEQ ID NO: 17307 - protein, 9 aa, Artificial Sequence
  Description of Artificial Sequence: Synthetic peptide
  Seed: TRQLCDLRL (PIK3CA R88Q)
THQLCDLRC

SEQ ID NO: 17308 - protein, 9 aa, Artificial Sequence
  Description of Artificial Sequence: Synthetic peptide
  Seed: TRQLCDLRL (PIK3CA R88Q)
THQLCDLRF

SEQ ID NO: 17309 - protein, 9 aa, Artificial Sequence
  Description of Artificial Sequence: Synthetic peptide
  Seed: TRQLCDLRL (PIK3CA R88Q)
THQLCDLRI

SEQ ID NO: 17310 - protein, 9 aa, Artificial Sequence
  Description of Artificial Sequence: Synthetic peptide
  Seed: TRQLCDLRL (PIK3CA R88Q)
THQLCDLRL

SEQ ID NO: 17311 - protein, 9 aa, Artificial Sequence
  Description of Artificial Sequence: Synthetic peptide
  Seed: TRQLCDLRL (PIK3CA R88Q)
THQLCDLRM

SEQ ID NO: 17312 - protein, 9 aa, Artificial Sequence
  Description of Artificial Sequence: Synthetic peptide
  Seed: TRQLCDLRL (PIK3CA R88Q)
THQLCDLRV

SEQ ID NO: 17313 - protein, 9 aa, Artificial Sequence
  Description of Artificial Sequence: Synthetic peptide
  Seed: TRQLCDLRL (PIK3CA R88Q)
THQLCDLRW

SEQ ID NO: 17314 - protein, 9 aa, Artificial Sequence
  Description of Artificial Sequence: Synthetic peptide
  Seed: TRQLCDLRL (PIK3CA R88Q)
THQLCDLRY

SEQ ID NO: 17315 - protein, 9 aa, Artificial Sequence
  Description of Artificial Sequence: Synthetic peptide
  Seed: TRQLCDLRL (PIK3CA R88Q)
TLQLCDLRL

SEQ ID NO: 17316 - protein, 9 aa, Artificial Sequence
  Description of Artificial Sequence: Synthetic peptide
  Seed: TRQLCDLRL (PIK3CA R88Q)
TMQLCDLRL

SEQ ID NO: 17317 - protein, 9 aa, Artificial Sequence
  Description of Artificial Sequence: Synthetic peptide
  Seed: TRQLCDLRL (PIK3CA R88Q)
TQQLCDLRF

SEQ ID NO: 17318 - protein, 9 aa, Artificial Sequence
  Description of Artificial Sequence: Synthetic peptide
  Seed: TRQLCDLRL (PIK3CA R88Q)
TQQLCDLRI

SEQ ID NO: 17319 - protein, 9 aa, Artificial Sequence
  Description of Artificial Sequence: Synthetic peptide
  Seed: TRQLCDLRL (PIK3CA R88Q)
TQQLCDLRL

SEQ ID NO: 17320 - protein, 9 aa, Artificial Sequence
  Description of Artificial Sequence: Synthetic peptide
  Seed: TRQLCDLRL (PIK3CA R88Q)
TQQLCDLRM

SEQ ID NO: 17321 - protein, 9 aa, Artificial Sequence
  Description of Artificial Sequence: Synthetic peptide
  Seed: TRQLCDLRL (PIK3CA R88Q)
TQQLCDLRV

SEQ ID NO: 17322 - protein, 9 aa, Artificial Sequence
  Description of Artificial Sequence: Synthetic peptide
  Seed: TRQLCDLRL (PIK3CA R88Q)
TRQLCDLRH

SEQ ID NO: 17323 - protein, 10 aa, Artificial Sequence
  Description of Artificial Sequence: Synthetic peptide
  Seed: TRQLCDLRLF (PIK3CA R88Q)
TRQLCDLRLW

SEQ ID NO: 17324 - protein, 9 aa, Artificial Sequence
  Description of Artificial Sequence: Synthetic peptide
  Seed: TRQLCDLRL (PIK3CA R88Q)
TRQLCDLRW

SEQ ID NO: 17325 - protein, 9 aa, Artificial Sequence
  Description of Artificial Sequence: Synthetic peptide
  Seed: TRQLCDLRL (PIK3CA R88Q)
TRQLCDLRY

SEQ ID NO: 17326 - protein, 9 aa, Artificial Sequence
  Description of Artificial Sequence: Synthetic peptide
  Seed: TRQLCDLRL (PIK3CA R88Q)
TYQLCDLRF

SEQ ID NO: 17327 - protein, 9 aa, Artificial Sequence
  Description of Artificial Sequence: Synthetic peptide
  Seed: TRQLCDLRL (PIK3CA R88Q)
TYQLCDLRL

SEQ ID NO: 17328 - protein, 9 aa, Artificial Sequence
  Description of Artificial Sequence: Synthetic peptide
  Seed: TRQLCDLRL (PIK3CA R88Q)
TYQLCDLRM

SEQ ID NO: 17329 - protein, 9 aa, Artificial Sequence
  Description of Artificial Sequence: Synthetic peptide
  Seed: TRQLCDLRL (PIK3CA R88Q)
TYQLCDLRY

SEQ ID NO: 17330 - protein, 10 aa, Homo sapiens
  Native (PIK3CA R88Q)
DETRQLCDLR

SEQ ID NO: 17331 - protein, 9 aa, Homo sapiens
  Native (PIK3CA R88Q)
EFFDETRQL

SEQ ID NO: 17332 - protein, 8 aa, Homo sapiens
  Native (PIK3CA R88Q)
FFDETRQL

SEQ ID NO: 17333 - protein, 11 aa, Homo sapiens
  Native (PIK3CA R88Q)
QLCDLRLFQPF

SEQ ID NO: 17334 - protein, 11 aa, Homo sapiens
  Native (PIK3CA R88Q)
REEFFDETRQL

SEQ ID NO: 17335 - protein, 9 aa, Homo sapiens
  Native (PIK3CA R88Q)
TRQLCDLRL

SEQ ID NO: 17336 - protein, 10 aa, Homo sapiens
  Native (PIK3CA R88Q)
TRQLCDLRLF

SEQ ID NO: 17337 - protein, 9 aa, Homo sapiens
  Native (PIK3CA R88Q)
DETRQLCDL

SEQ ID NO: 17338 - protein, 10 aa, Homo sapiens
  Native (PIK3CA R88Q)
EEFFDETRQL

SEQ ID NO: 17339 - protein, 11 aa, Homo sapiens
  Native (PIK3CA R88Q)
EEFFDETRQLC

SEQ ID NO: 17340 - protein, 11 aa, Homo sapiens
  Native (PIK3CA R88Q)
ETRQLCDLRLF

SEQ ID NO: 17341 - protein, 9 aa, Homo sapiens
  Native (PIK3CA R88Q)
FFDETRQLC

SEQ ID NO: 17342 - protein, 11 aa, Homo sapiens
  Native (PIK3CA R88Q)
FFDETRQLCDL

SEQ ID NO: 17343 - protein, 9 aa, Artificial Sequence
  Description of Artificial Sequence: Synthetic peptide
  Seed: GTGVMICAY (PTEN R130G)
GAGVMICAF

SEQ ID NO: 17344 - protein, 9 aa, Artificial Sequence
  Description of Artificial Sequence: Synthetic peptide
  Seed: GTGVMICAY (PTEN R130G)
GAGVMICAY

SEQ ID NO: 17345 - protein, 10 aa, Artificial Sequence
  Description of Artificial Sequence: Synthetic peptide
  Seed: GTGVMICAYL (PTEN R130G)
GAGVMICAYV

SEQ ID NO: 17346 - protein, 9 aa, Artificial Sequence
  Description of Artificial Sequence: Synthetic peptide
  Seed: GTGVMICAY (PTEN R130G)
GFGVMICAY

SEQ ID NO: 17347 - protein, 9 aa, Artificial Sequence
  Description of Artificial Sequence: Synthetic peptide
  Seed: GTGVMICAY (PTEN R130G)
GGGVMICAY

SEQ ID NO: 17348 - protein, 9 aa, Artificial Sequence
  Description of Artificial Sequence: Synthetic peptide
  Seed: GTGVMICAY (PTEN R130G)
GIGVMICAF

SEQ ID NO: 17349 - protein, 9 aa, Artificial Sequence
  Description of Artificial Sequence: Synthetic peptide
  Seed: GTGVMICAY (PTEN R130G)
GIGVMICAY

SEQ ID NO: 17350 - protein, 10 aa, Artificial Sequence
  Description of Artificial Sequence: Synthetic peptide
  Seed: GTGVMICAYL (PTEN R130G)
GIGVMICAYI

SEQ ID NO: 17351 - protein, 10 aa, Artificial Sequence
  Description of Artificial Sequence: Synthetic peptide
  Seed: GTGVMICAYL (PTEN R130G)
GIGVMICAYL

SEQ ID NO: 17352 - protein, 10 aa, Artificial Sequence
  Description of Artificial Sequence: Synthetic peptide
  Seed: GTGVMICAYL (PTEN R130G)
GIGVMICAYV

SEQ ID NO: 17353 - protein, 9 aa, Artificial Sequence
  Description of Artificial Sequence: Synthetic peptide
  Seed: GTGVMICAY (PTEN R130G)
GLGVMICAF

SEQ ID NO: 17354 - protein, 9 aa, Artificial Sequence
  Description of Artificial Sequence: Synthetic peptide
  Seed: GTGVMICAY (PTEN R130G)
GLGVMICAY

SEQ ID NO: 17355 - protein, 10 aa, Artificial Sequence
  Description of Artificial Sequence: Synthetic peptide
  Seed: GTGVMICAYL (PTEN R130G)
GLGVMICAYA

SEQ ID NO: 17356 - protein, 10 aa, Artificial Sequence
  Description of Artificial Sequence: Synthetic peptide
  Seed: GTGVMICAYL (PTEN R130G)
GLGVMICAYI

SEQ ID NO: 17357 - protein, 10 aa, Artificial Sequence
  Description of Artificial Sequence: Synthetic peptide
  Seed: GTGVMICAYL (PTEN R130G)
GLGVMICAYL

SEQ ID NO: 17358 - protein, 10 aa, Artificial Sequence
  Description of Artificial Sequence: Synthetic peptide
  Seed: GTGVMICAYL (PTEN R130G)
GLGVMICAYM

SEQ ID NO: 17359 - protein, 10 aa, Artificial Sequence
  Description of Artificial Sequence: Synthetic peptide
  Seed: GTGVMICAYL (PTEN R130G)
GLGVMICAYT

SEQ ID NO: 17360 - protein, 9 aa, Artificial Sequence
  Description of Artificial Sequence: Synthetic peptide
  Seed: GTGVMICAY (PTEN R130G)
GMGVMICAF

SEQ ID NO: 17361 - protein, 9 aa, Artificial Sequence
  Description of Artificial Sequence: Synthetic peptide
  Seed: GTGVMICAY (PTEN R130G)
GMGVMICAM

SEQ ID NO: 17362 - protein, 9 aa, Artificial Sequence
  Description of Artificial Sequence: Synthetic peptide
  Seed: GTGVMICAY (PTEN R130G)
GMGVMICAY

SEQ ID NO: 17363 - protein, 10 aa, Artificial Sequence
  Description of Artificial Sequence: Synthetic peptide
  Seed: GTGVMICAYL (PTEN R130G)
GMGVMICAYA

SEQ ID NO: 17364 - protein, 10 aa, Artificial Sequence
  Description of Artificial Sequence: Synthetic peptide
  Seed: GTGVMICAYL (PTEN R130G)
GMGVMICAYI

SEQ ID NO: 17365 - protein, 10 aa, Artificial Sequence
  Description of Artificial Sequence: Synthetic peptide
  Seed: GTGVMICAYL (PTEN R130G)
GMGVMICAYM

SEQ ID NO: 17366 - protein, 10 aa, Artificial Sequence
  Description of Artificial Sequence: Synthetic peptide
  Seed: GTGVMICAYL (PTEN R130G)
GMGVMICAYT

SEQ ID NO: 17367 - protein, 9 aa, Artificial Sequence
  Description of Artificial Sequence: Synthetic peptide
  Seed: GTGVMICAY (PTEN R130G)
GNGVMICAY

SEQ ID NO: 17368 - protein, 9 aa, Artificial Sequence
  Description of Artificial Sequence: Synthetic peptide
  Seed: GTGVMICAY (PTEN R130G)
GQGVMICAL

SEQ ID NO: 17369 - protein, 9 aa, Artificial Sequence
  Description of Artificial Sequence: Synthetic peptide
  Seed: GTGVMICAY (PTEN R130G)
GQGVMICAM

SEQ ID NO: 17370 - protein, 10 aa, Artificial Sequence
  Description of Artificial Sequence: Synthetic peptide
  Seed: GTGVMICAYL (PTEN R130G)
GQGVMICAYI

SEQ ID NO: 17371 - protein, 10 aa, Artificial Sequence
  Description of Artificial Sequence: Synthetic peptide
  Seed: GTGVMICAYL (PTEN R130G)
GQGVMICAYL

SEQ ID NO: 17372 - protein, 10 aa, Artificial Sequence
  Description of Artificial Sequence: Synthetic peptide
  Seed: GTGVMICAYL (PTEN R130G)
GQGVMICAYV

SEQ ID NO: 17373 - protein, 9 aa, Artificial Sequence
  Description of Artificial Sequence: Synthetic peptide
  Seed: GTGVMICAY (PTEN R130G)
GSGVMICAF

SEQ ID NO: 17374 - protein, 9 aa, Artificial Sequence
  Description of Artificial Sequence: Synthetic peptide
  Seed: GTGVMICAY (PTEN R130G)
GSGVMICAW

SEQ ID NO: 17375 - protein, 9 aa, Artificial Sequence
  Description of Artificial Sequence: Synthetic peptide
  Seed: GTGVMICAY (PTEN R130G)
GSGVMICAY

SEQ ID NO: 17376 - protein, 10 aa, Artificial Sequence
  Description of Artificial Sequence: Synthetic peptide
  Seed: GTGVMICAYL (PTEN R130G)
GSGVMICAYV

SEQ ID NO: 17377 - protein, 9 aa, Artificial Sequence
  Description of Artificial Sequence: Synthetic peptide
  Seed: GTGVMICAY (PTEN R130G)
GTGVMICAF

SEQ ID NO: 17378 - protein, 9 aa, Artificial Sequence
  Description of Artificial Sequence: Synthetic peptide
  Seed: GTGVMICAY (PTEN R130G)
GTGVMICAW

SEQ ID NO: 17379 - protein, 10 aa, Artificial Sequence
  Description of Artificial Sequence: Synthetic peptide
  Seed: GTGVMICAYL (PTEN R130G)
GTGVMICAYV

SEQ ID NO: 17380 - protein, 9 aa, Artificial Sequence
  Description of Artificial Sequence: Synthetic peptide
  Seed: GTGVMICAY (PTEN R130G)
GVGVMICAF

SEQ ID NO: 17381 - protein, 9 aa, Artificial Sequence
  Description of Artificial Sequence: Synthetic peptide
  Seed: GTGVMICAY (PTEN R130G)
GVGVMICAY

SEQ ID NO: 17382 - protein, 10 aa, Artificial Sequence
  Description of Artificial Sequence: Synthetic peptide
  Seed: GTGVMICAYL (PTEN R130G)
GVGVMICAYL

SEQ ID NO: 17383 - protein, 10 aa, Artificial Sequence
  Description of Artificial Sequence: Synthetic peptide
  Seed: GTGVMICAYL (PTEN R130G)
GVGVMICAYV

SEQ ID NO: 17384 - protein, 9 aa, Artificial Sequence
  Description of Artificial Sequence: Synthetic peptide
  Seed: GTGVMICAY (PTEN R130G)
GWGVMICAY

SEQ ID NO: 17385 - protein, 9 aa, Artificial Sequence
  Description of Artificial Sequence: Synthetic peptide
  Seed: GTGVMICAY (PTEN R130G)
GYGVMICAY

SEQ ID NO: 17386 - protein, 9 aa, Artificial Sequence
  Description of Artificial Sequence: Synthetic peptide
  Seed: AGKGGTGVM (PTEN R130G)
AAKGGTGVA

SEQ ID NO: 17387 - protein, 9 aa, Artificial Sequence
  Description of Artificial Sequence: Synthetic peptide
  Seed: AGKGGTGVM (PTEN R130G)
AAKGGTGVC

SEQ ID NO: 17388 - protein, 9 aa, Artificial Sequence
  Description of Artificial Sequence: Synthetic peptide
  Seed: AGKGGTGVM (PTEN R130G)
AAKGGTGVE

SEQ ID NO: 17389 - protein, 9 aa, Artificial Sequence
  Description of Artificial Sequence: Synthetic peptide
  Seed: AGKGGTGVM (PTEN R130G)
AAKGGTGVF

SEQ ID NO: 17390 - protein, 9 aa, Artificial Sequence
  Description of Artificial Sequence: Synthetic peptide
  Seed: AGKGGTGVM (PTEN R130G)
AAKGGTGVG

SEQ ID NO: 17391 - protein, 9 aa, Artificial Sequence
  Description of Artificial Sequence: Synthetic peptide
  Seed: AGKGGTGVM (PTEN R130G)
AAKGGTGVH

SEQ ID NO: 17392 - protein, 9 aa, Artificial Sequence
  Description of Artificial Sequence: Synthetic peptide
  Seed: AGKGGTGVM (PTEN R130G)
AAKGGTGVI

SEQ ID NO: 17393 - protein, 9 aa, Artificial Sequence
  Description of Artificial Sequence: Synthetic peptide
  Seed: AGKGGTGVM (PTEN R130G)
AAKGGTGVK

SEQ ID NO: 17394 - protein, 9 aa, Artificial Sequence
  Description of Artificial Sequence: Synthetic peptide
  Seed: AGKGGTGVM (PTEN R130G)
AAKGGTGVM

SEQ ID NO: 17395 - protein, 9 aa, Artificial Sequence
  Description of Artificial Sequence: Synthetic peptide
  Seed: AGKGGTGVM (PTEN R130G)
AAKGGTGVN

SEQ ID NO: 17396 - protein, 9 aa, Artificial Sequence
  Description of Artificial Sequence: Synthetic peptide
  Seed: AGKGGTGVM (PTEN R130G)
AAKGGTGVP

SEQ ID NO: 17397 - protein, 9 aa, Artificial Sequence
  Description of Artificial Sequence: Synthetic peptide
  Seed: AGKGGTGVM (PTEN R130G)
AAKGGTGVQ

SEQ ID NO: 17398 - protein, 9 aa, Artificial Sequence
  Description of Artificial Sequence: Synthetic peptide
  Seed: AGKGGTGVM (PTEN R130G)
AAKGGTGVR

SEQ ID NO: 17399 - protein, 9 aa, Artificial Sequence
  Description of Artificial Sequence: Synthetic peptide
  Seed: AGKGGTGVM (PTEN R130G)
AAKGGTGVS

SEQ ID NO: 17400 - protein, 9 aa, Artificial Sequence
  Description of Artificial Sequence: Synthetic peptide
  Seed: AGKGGTGVM (PTEN R130G)
AAKGGTGVT

SEQ ID NO: 17401 - protein, 9 aa, Artificial Sequence
  Description of Artificial Sequence: Synthetic peptide
  Seed: AGKGGTGVM (PTEN R130G)
AAKGGTGVV

SEQ ID NO: 17402 - protein, 9 aa, Artificial Sequence
  Description of Artificial Sequence: Synthetic peptide
  Seed: AGKGGTGVM (PTEN R130G)
AAKGGTGVW

SEQ ID NO: 17403 - protein, 9 aa, Artificial Sequence
  Description of Artificial Sequence: Synthetic peptide
  Seed: AGKGGTGVM (PTEN R130G)
ACKGGTGVF

SEQ ID NO: 17404 - protein, 9 aa, Artificial Sequence
  Description of Artificial Sequence: Synthetic peptide
  Seed: AGKGGTGVM (PTEN R130G)
ACKGGTGVH

SEQ ID NO: 17405 - protein, 9 aa, Artificial Sequence
  Description of Artificial Sequence: Synthetic peptide
  Seed: AGKGGTGVM (PTEN R130G)
ACKGGTGVI

SEQ ID NO: 17406 - protein, 9 aa, Artificial Sequence
  Description of Artificial Sequence: Synthetic peptide
  Seed: AGKGGTGVM (PTEN R130G)
ACKGGTGVL

SEQ ID NO: 17407 - protein, 9 aa, Artificial Sequence
  Description of Artificial Sequence: Synthetic peptide
  Seed: AGKGGTGVM (PTEN R130G)
ACKGGTGVM

SEQ ID NO: 17408 - protein, 9 aa, Artificial Sequence
  Description of Artificial Sequence: Synthetic peptide
  Seed: AGKGGTGVM (PTEN R130G)
ACKGGTGVV

SEQ ID NO: 17409 - protein, 9 aa, Artificial Sequence
  Description of Artificial Sequence: Synthetic peptide
  Seed: AGKGGTGVM (PTEN R130G)
ACKGGTGVY

SEQ ID NO: 17410 - protein, 9 aa, Artificial Sequence
  Description of Artificial Sequence: Synthetic peptide
  Seed: AGKGGTGVM (PTEN R130G)
ADKGGTGVF

SEQ ID NO: 17411 - protein, 9 aa, Artificial Sequence
  Description of Artificial Sequence: Synthetic peptide
  Seed: AGKGGTGVM (PTEN R130G)
ADKGGTGVK

SEQ ID NO: 17412 - protein, 9 aa, Artificial Sequence
  Description of Artificial Sequence: Synthetic peptide
  Seed: AGKGGTGVM (PTEN R130G)
ADKGGTGVL

SEQ ID NO: 17413 - protein, 9 aa, Artificial Sequence
  Description of Artificial Sequence: Synthetic peptide
  Seed: AGKGGTGVM (PTEN R130G)
ADKGGTGVM

SEQ ID NO: 17414 - protein, 9 aa, Artificial Sequence
  Description of Artificial Sequence: Synthetic peptide
  Seed: AGKGGTGVM (PTEN R130G)
ADKGGTGVR

SEQ ID NO: 17415 - protein, 9 aa, Artificial Sequence
  Description of Artificial Sequence: Synthetic peptide
  Seed: AGKGGTGVM (PTEN R130G)
ADKGGTGVY

SEQ ID NO: 17416 - protein, 9 aa, Artificial Sequence
  Description of Artificial Sequence: Synthetic peptide
  Seed: AGKGGTGVM (PTEN R130G)
AEKGGTGVF

SEQ ID NO: 17417 - protein, 9 aa, Artificial Sequence
  Description of Artificial Sequence: Synthetic peptide
  Seed: AGKGGTGVM (PTEN R130G)
AEKGGTGVH

SEQ ID NO: 17418 - protein, 9 aa, Artificial Sequence
  Description of Artificial Sequence: Synthetic peptide
  Seed: AGKGGTGVM (PTEN R130G)
AEKGGTGVI

SEQ ID NO: 17419 - protein, 9 aa, Artificial Sequence
  Description of Artificial Sequence: Synthetic peptide
  Seed: AGKGGTGVM (PTEN R130G)
AEKGGTGVL

SEQ ID NO: 17420 - protein, 9 aa, Artificial Sequence
  Description of Artificial Sequence: Synthetic peptide
  Seed: AGKGGTGVM (PTEN R130G)
AEKGGTGVM

SEQ ID NO: 17421 - protein, 9 aa, Artificial Sequence
  Description of Artificial Sequence: Synthetic peptide
  Seed: AGKGGTGVM (PTEN R130G)
AEKGGTGVV

SEQ ID NO: 17422 - protein, 9 aa, Artificial Sequence
  Description of Artificial Sequence: Synthetic peptide
  Seed: AGKGGTGVM (PTEN R130G)
AEKGGTGVW

SEQ ID NO: 17423 - protein, 9 aa, Artificial Sequence
  Description of Artificial Sequence: Synthetic peptide
  Seed: AGKGGTGVM (PTEN R130G)
AEKGGTGVY

SEQ ID NO: 17424 - protein, 9 aa, Artificial Sequence
  Description of Artificial Sequence: Synthetic peptide
  Seed: AGKGGTGVM (PTEN R130G)
AFKGGTGVF

SEQ ID NO: 17425 - protein, 9 aa, Artificial Sequence
  Description of Artificial Sequence: Synthetic peptide
  Seed: AGKGGTGVM (PTEN R130G)
AFKGGTGVH

SEQ ID NO: 17426 - protein, 9 aa, Artificial Sequence
  Description of Artificial Sequence: Synthetic peptide
  Seed: AGKGGTGVM (PTEN R130G)
AFKGGTGVI

SEQ ID NO: 17427 - protein, 9 aa, Artificial Sequence
  Description of Artificial Sequence: Synthetic peptide
  Seed: AGKGGTGVM (PTEN R130G)
AFKGGTGVL

SEQ ID NO: 17428 - protein, 9 aa, Artificial Sequence
  Description of Artificial Sequence: Synthetic peptide
  Seed: AGKGGTGVM (PTEN R130G)
AFKGGTGVM

SEQ ID NO: 17429 - protein, 9 aa, Artificial Sequence
  Description of Artificial Sequence: Synthetic peptide
  Seed: AGKGGTGVM (PTEN R130G)
AFKGGTGVV

SEQ ID NO: 17430 - protein, 9 aa, Artificial Sequence
  Description of Artificial Sequence: Synthetic peptide
  Seed: AGKGGTGVM (PTEN R130G)
AFKGGTGVY

SEQ ID NO: 17431 - protein, 9 aa, Artificial Sequence
  Description of Artificial Sequence: Synthetic peptide
  Seed: AGKGGTGVM (PTEN R130G)
AGKGGTGVA

SEQ ID NO: 17432 - protein, 9 aa, Artificial Sequence
  Description of Artificial Sequence: Synthetic peptide
  Seed: AGKGGTGVM (PTEN R130G)
AGKGGTGVF

SEQ ID NO: 17433 - protein, 9 aa, Artificial Sequence
  Description of Artificial Sequence: Synthetic peptide
  Seed: AGKGGTGVM (PTEN R130G)
AGKGGTGVH

SEQ ID NO: 17434 - protein, 9 aa, Artificial Sequence
  Description of Artificial Sequence: Synthetic peptide
  Seed: AGKGGTGVM (PTEN R130G)
AGKGGTGVI

SEQ ID NO: 17435 - protein, 9 aa, Artificial Sequence
  Description of Artificial Sequence: Synthetic peptide
  Seed: AGKGGTGVM (PTEN R130G)
AGKGGTGVK

SEQ ID NO: 17436 - protein, 9 aa, Artificial Sequence
  Description of Artificial Sequence: Synthetic peptide
  Seed: AGKGGTGVM (PTEN R130G)
AGKGGTGVL

SEQ ID NO: 17437 - protein, 9 aa, Artificial Sequence
  Description of Artificial Sequence: Synthetic peptide
  Seed: AGKGGTGVM (PTEN R130G)
AGKGGTGVR

SEQ ID NO: 17438 - protein, 9 aa, Artificial Sequence
  Description of Artificial Sequence: Synthetic peptide
  Seed: AGKGGTGVM (PTEN R130G)
AGKGGTGVV

SEQ ID NO: 17439 - protein, 9 aa, Artificial Sequence
  Description of Artificial Sequence: Synthetic peptide
  Seed: AGKGGTGVM (PTEN R130G)
AGKGGTGVW

SEQ ID NO: 17440 - protein, 9 aa, Artificial Sequence
  Description of Artificial Sequence: Synthetic peptide
  Seed: AGKGGTGVM (PTEN R130G)
AGKGGTGVY

SEQ ID NO: 17441 - protein, 9 aa, Artificial Sequence
  Description of Artificial Sequence: Synthetic peptide
  Seed: AGKGGTGVM (PTEN R130G)
AHKGGTGVF

SEQ ID NO: 17442 - protein, 9 aa, Artificial Sequence
  Description of Artificial Sequence: Synthetic peptide
  Seed: AGKGGTGVM (PTEN R130G)
AHKGGTGVI

SEQ ID NO: 17443 - protein, 9 aa, Artificial Sequence
  Description of Artificial Sequence: Synthetic peptide
  Seed: AGKGGTGVM (PTEN R130G)
AHKGGTGVL

SEQ ID NO: 17444 - protein, 9 aa, Artificial Sequence
  Description of Artificial Sequence: Synthetic peptide
  Seed: AGKGGTGVM (PTEN R130G)
AHKGGTGVM

SEQ ID NO: 17445 - protein, 9 aa, Artificial Sequence
  Description of Artificial Sequence: Synthetic peptide
  Seed: AGKGGTGVM (PTEN R130G)
AHKGGTGVV

SEQ ID NO: 17446 - protein, 9 aa, Artificial Sequence
  Description of Artificial Sequence: Synthetic peptide
  Seed: AGKGGTGVM (PTEN R130G)
AHKGGTGVY

SEQ ID NO: 17447 - protein, 9 aa, Artificial Sequence
  Description of Artificial Sequence: Synthetic peptide
  Seed: AGKGGTGVM (PTEN R130G)
AIKGGTGVA

SEQ ID NO: 17448 - protein, 9 aa, Artificial Sequence
  Description of Artificial Sequence: Synthetic peptide
  Seed: AGKGGTGVM (PTEN R130G)
AIKGGTGVC

SEQ ID NO: 17449 - protein, 9 aa, Artificial Sequence
  Description of Artificial Sequence: Synthetic peptide
  Seed: AGKGGTGVM (PTEN R130G)
AIKGGTGVF

SEQ ID NO: 17450 - protein, 9 aa, Artificial Sequence
  Description of Artificial Sequence: Synthetic peptide
  Seed: AGKGGTGVM (PTEN R130G)
AIKGGTGVH

SEQ ID NO: 17451 - protein, 9 aa, Artificial Sequence
  Description of Artificial Sequence: Synthetic peptide
  Seed: AGKGGTGVM (PTEN R130G)
AIKGGTGVI

SEQ ID NO: 17452 - protein, 9 aa, Artificial Sequence
  Description of Artificial Sequence: Synthetic peptide
  Seed: AGKGGTGVM (PTEN R130G)
AIKGGTGVK

SEQ ID NO: 17453 - protein, 9 aa, Artificial Sequence
  Description of Artificial Sequence: Synthetic peptide
  Seed: AGKGGTGVM (PTEN R130G)
AIKGGTGVL

SEQ ID NO: 17454 - protein, 9 aa, Artificial Sequence
  Description of Artificial Sequence: Synthetic peptide
  Seed: AGKGGTGVM (PTEN R130G)
AIKGGTGVM

SEQ ID NO: 17455 - protein, 9 aa, Artificial Sequence
  Description of Artificial Sequence: Synthetic peptide
  Seed: AGKGGTGVM (PTEN R130G)
AIKGGTGVQ

SEQ ID NO: 17456 - protein, 9 aa, Artificial Sequence
  Description of Artificial Sequence: Synthetic peptide
  Seed: AGKGGTGVM (PTEN R130G)
AIKGGTGVR

SEQ ID NO: 17457 - protein, 9 aa, Artificial Sequence
  Description of Artificial Sequence: Synthetic peptide
  Seed: AGKGGTGVM (PTEN R130G)
AIKGGTGVT

SEQ ID NO: 17458 - protein, 9 aa, Artificial Sequence
  Description of Artificial Sequence: Synthetic peptide
  Seed: AGKGGTGVM (PTEN R130G)
AIKGGTGVV

SEQ ID NO: 17459 - protein, 9 aa, Artificial Sequence
  Description of Artificial Sequence: Synthetic peptide
  Seed: AGKGGTGVM (PTEN R130G)
AIKGGTGVW

SEQ ID NO: 17460 - protein, 9 aa, Artificial Sequence
  Description of Artificial Sequence: Synthetic peptide
  Seed: AGKGGTGVM (PTEN R130G)
AIKGGTGVY

SEQ ID NO: 17461 - protein, 9 aa, Artificial Sequence
  Description of Artificial Sequence: Synthetic peptide
  Seed: AGKGGTGVM (PTEN R130G)
AKKGGTGVF

SEQ ID NO: 17462 - protein, 9 aa, Artificial Sequence
  Description of Artificial Sequence: Synthetic peptide
  Seed: AGKGGTGVM (PTEN R130G)
AKKGGTGVL

SEQ ID NO: 17463 - protein, 9 aa, Artificial Sequence
  Description of Artificial Sequence: Synthetic peptide
  Seed: AGKGGTGVM (PTEN R130G)
AKKGGTGVM

SEQ ID NO: 17464 - protein, 9 aa, Artificial Sequence
  Description of Artificial Sequence: Synthetic peptide
  Seed: AGKGGTGVM (PTEN R130G)
AKKGGTGVY

SEQ ID NO: 17465 - protein, 9 aa, Artificial Sequence
  Description of Artificial Sequence: Synthetic peptide
  Seed: AGKGGTGVM (PTEN R130G)
ALKGGTGVA

SEQ ID NO: 17466 - protein, 9 aa, Artificial Sequence
  Description of Artificial Sequence: Synthetic peptide
  Seed: AGKGGTGVM (PTEN R130G)
ALKGGTGVC

SEQ ID NO: 17467 - protein, 9 aa, Artificial Sequence
  Description of Artificial Sequence: Synthetic peptide
  Seed: AGKGGTGVM (PTEN R130G)
ALKGGTGVF

SEQ ID NO: 17468 - protein, 9 aa, Artificial Sequence
  Description of Artificial Sequence: Synthetic peptide
  Seed: AGKGGTGVM (PTEN R130G)
ALKGGTGVH

SEQ ID NO: 17469 - protein, 9 aa, Artificial Sequence
  Description of Artificial Sequence: Synthetic peptide
  Seed: AGKGGTGVM (PTEN R130G)
ALKGGTGVI

SEQ ID NO: 17470 - protein, 9 aa, Artificial Sequence
  Description of Artificial Sequence: Synthetic peptide
  Seed: AGKGGTGVM (PTEN R130G)
ALKGGTGVK

SEQ ID NO: 17471 - protein, 9 aa, Artificial Sequence
  Description of Artificial Sequence: Synthetic peptide
  Seed: AGKGGTGVM (PTEN R130G)
ALKGGTGVL

SEQ ID NO: 17472 - protein, 9 aa, Artificial Sequence
  Description of Artificial Sequence: Synthetic peptide
  Seed: AGKGGTGVM (PTEN R130G)
ALKGGTGVM

SEQ ID NO: 17473 - protein, 9 aa, Artificial Sequence
  Description of Artificial Sequence: Synthetic peptide
  Seed: AGKGGTGVM (PTEN R130G)
ALKGGTGVR

SEQ ID NO: 17474 - protein, 9 aa, Artificial Sequence
  Description of Artificial Sequence: Synthetic peptide
  Seed: AGKGGTGVM (PTEN R130G)
ALKGGTGVV

SEQ ID NO: 17475 - protein, 9 aa, Artificial Sequence
  Description of Artificial Sequence: Synthetic peptide
  Seed: AGKGGTGVM (PTEN R130G)
ALKGGTGVW

SEQ ID NO: 17476 - protein, 9 aa, Artificial Sequence
  Description of Artificial Sequence: Synthetic peptide
  Seed: AGKGGTGVM (PTEN R130G)
ALKGGTGVY

SEQ ID NO: 17477 - protein, 9 aa, Artificial Sequence
  Description of Artificial Sequence: Synthetic peptide
  Seed: AGKGGTGVM (PTEN R130G)
AMKGGTGVA

SEQ ID NO: 17478 - protein, 9 aa, Artificial Sequence
  Description of Artificial Sequence: Synthetic peptide
  Seed: AGKGGTGVM (PTEN R130G)
AMKGGTGVC

SEQ ID NO: 17479 - protein, 9 aa, Artificial Sequence
  Description of Artificial Sequence: Synthetic peptide
  Seed: AGKGGTGVM (PTEN R130G)
AMKGGTGVF

SEQ ID NO: 17480 - protein, 9 aa, Artificial Sequence
  Description of Artificial Sequence: Synthetic peptide
  Seed: AGKGGTGVM (PTEN R130G)
AMKGGTGVH

SEQ ID NO: 17481 - protein, 9 aa, Artificial Sequence
  Description of Artificial Sequence: Synthetic peptide
  Seed: AGKGGTGVM (PTEN R130G)
AMKGGTGVI

SEQ ID NO: 17482 - protein, 9 aa, Artificial Sequence
  Description of Artificial Sequence: Synthetic peptide
  Seed: AGKGGTGVM (PTEN R130G)
AMKGGTGVL

SEQ ID NO: 17483 - protein, 9 aa, Artificial Sequence
  Description of Artificial Sequence: Synthetic peptide
  Seed: AGKGGTGVM (PTEN R130G)
AMKGGTGVM

SEQ ID NO: 17484 - protein, 9 aa, Artificial Sequence
  Description of Artificial Sequence: Synthetic peptide
  Seed: AGKGGTGVM (PTEN R130G)
AMKGGTGVV

SEQ ID NO: 17485 - protein, 9 aa, Artificial Sequence
  Description of Artificial Sequence: Synthetic peptide
  Seed: AGKGGTGVM (PTEN R130G)
AMKGGTGVW

SEQ ID NO: 17486 - protein, 9 aa, Artificial Sequence
  Description of Artificial Sequence: Synthetic peptide
  Seed: AGKGGTGVM (PTEN R130G)
AMKGGTGVY

SEQ ID NO: 17487 - protein, 9 aa, Artificial Sequence
  Description of Artificial Sequence: Synthetic peptide
  Seed: AGKGGTGVM (PTEN R130G)
ANKGGTGVF

SEQ ID NO: 17488 - protein, 9 aa, Artificial Sequence
  Description of Artificial Sequence: Synthetic peptide
  Seed: AGKGGTGVM (PTEN R130G)
ANKGGTGVH

SEQ ID NO: 17489 - protein, 9 aa, Artificial Sequence
  Description of Artificial Sequence: Synthetic peptide
  Seed: AGKGGTGVM (PTEN R130G)
ANKGGTGVI

SEQ ID NO: 17490 - protein, 9 aa, Artificial Sequence
  Description of Artificial Sequence: Synthetic peptide
  Seed: AGKGGTGVM (PTEN R130G)
ANKGGTGVK

SEQ ID NO: 17491 - protein, 9 aa, Artificial Sequence
  Description of Artificial Sequence: Synthetic peptide
  Seed: AGKGGTGVM (PTEN R130G)
ANKGGTGVL

SEQ ID NO: 17492 - protein, 9 aa, Artificial Sequence
  Description of Artificial Sequence: Synthetic peptide
  Seed: AGKGGTGVM (PTEN R130G)
ANKGGTGVM

SEQ ID NO: 17493 - protein, 9 aa, Artificial Sequence
  Description of Artificial Sequence: Synthetic peptide
  Seed: AGKGGTGVM (PTEN R130G)
ANKGGTGVY

SEQ ID NO: 17494 - protein, 9 aa, Artificial Sequence
  Description of Artificial Sequence: Synthetic peptide
  Seed: AGKGGTGVM (PTEN R130G)
APKGGTGVA

SEQ ID NO: 17495 - protein, 9 aa, Artificial Sequence
  Description of Artificial Sequence: Synthetic peptide
  Seed: AGKGGTGVM (PTEN R130G)
APKGGTGVC

SEQ ID NO: 17496 - protein, 9 aa, Artificial Sequence
  Description of Artificial Sequence: Synthetic peptide
  Seed: AGKGGTGVM (PTEN R130G)
APKGGTGVE

SEQ ID NO: 17497 - protein, 9 aa, Artificial Sequence
  Description of Artificial Sequence: Synthetic peptide
  Seed: AGKGGTGVM (PTEN R130G)
APKGGTGVF

SEQ ID NO: 17498 - protein, 9 aa, Artificial Sequence
  Description of Artificial Sequence: Synthetic peptide
  Seed: AGKGGTGVM (PTEN R130G)
APKGGTGVG

SEQ ID NO: 17499 - protein, 9 aa, Artificial Sequence
  Description of Artificial Sequence: Synthetic peptide
  Seed: AGKGGTGVM (PTEN R130G)
APKGGTGVH

SEQ ID NO: 17500 - protein, 9 aa, Artificial Sequence
  Description of Artificial Sequence: Synthetic peptide
  Seed: AGKGGTGVM (PTEN R130G)
APKGGTGVI

SEQ ID NO: 17501 - protein, 9 aa, Artificial Sequence
  Description of Artificial Sequence: Synthetic peptide
  Seed: AGKGGTGVM (PTEN R130G)
APKGGTGVK

SEQ ID NO: 17502 - protein, 9 aa, Artificial Sequence
  Description of Artificial Sequence: Synthetic peptide
  Seed: AGKGGTGVM (PTEN R130G)
APKGGTGVN

SEQ ID NO: 17503 - protein, 9 aa, Artificial Sequence
  Description of Artificial Sequence: Synthetic peptide
  Seed: AGKGGTGVM (PTEN R130G)
APKGGTGVP

SEQ ID NO: 17504 - protein, 9 aa, Artificial Sequence
  Description of Artificial Sequence: Synthetic peptide
  Seed: AGKGGTGVM (PTEN R130G)
APKGGTGVQ

SEQ ID NO: 17505 - protein, 9 aa, Artificial Sequence
  Description of Artificial Sequence: Synthetic peptide
  Seed: AGKGGTGVM (PTEN R130G)
APKGGTGVR

SEQ ID NO: 17506 - protein, 9 aa, Artificial Sequence
  Description of Artificial Sequence: Synthetic peptide
  Seed: AGKGGTGVM (PTEN R130G)
APKGGTGVS

SEQ ID NO: 17507 - protein, 9 aa, Artificial Sequence
  Description of Artificial Sequence: Synthetic peptide
  Seed: AGKGGTGVM (PTEN R130G)
APKGGTGVT

SEQ ID NO: 17508 - protein, 9 aa, Artificial Sequence
  Description of Artificial Sequence: Synthetic peptide
  Seed: AGKGGTGVM (PTEN R130G)
APKGGTGVV

SEQ ID NO: 17509 - protein, 9 aa, Artificial Sequence
  Description of Artificial Sequence: Synthetic peptide
  Seed: AGKGGTGVM (PTEN R130G)
APKGGTGVW

SEQ ID NO: 17510 - protein, 9 aa, Artificial Sequence
  Description of Artificial Sequence: Synthetic peptide
  Seed: AGKGGTGVM (PTEN R130G)
APKGGTGVY

SEQ ID NO: 17511 - protein, 9 aa, Artificial Sequence
  Description of Artificial Sequence: Synthetic peptide
  Seed: AGKGGTGVM (PTEN R130G)
AQKGGTGVA

SEQ ID NO: 17512 - protein, 9 aa, Artificial Sequence
  Description of Artificial Sequence: Synthetic peptide
  Seed: AGKGGTGVM (PTEN R130G)
AQKGGTGVC

SEQ ID NO: 17513 - protein, 9 aa, Artificial Sequence
  Description of Artificial Sequence: Synthetic peptide
  Seed: AGKGGTGVM (PTEN R130G)
AQKGGTGVF

SEQ ID NO: 17514 - protein, 9 aa, Artificial Sequence
  Description of Artificial Sequence: Synthetic peptide
  Seed: AGKGGTGVM (PTEN R130G)
AQKGGTGVH

SEQ ID NO: 17515 - protein, 9 aa, Artificial Sequence
  Description of Artificial Sequence: Synthetic peptide
  Seed: AGKGGTGVM (PTEN R130G)
AQKGGTGVI

SEQ ID NO: 17516 - protein, 9 aa, Artificial Sequence
  Description of Artificial Sequence: Synthetic peptide
  Seed: AGKGGTGVM (PTEN R130G)
AQKGGTGVK

SEQ ID NO: 17517 - protein, 9 aa, Artificial Sequence
  Description of Artificial Sequence: Synthetic peptide
  Seed: AGKGGTGVM (PTEN R130G)
AQKGGTGVL

SEQ ID NO: 17518 - protein, 9 aa, Artificial Sequence
  Description of Artificial Sequence: Synthetic peptide
  Seed: AGKGGTGVM (PTEN R130G)
AQKGGTGVM

SEQ ID NO: 17519 - protein, 9 aa, Artificial Sequence
  Description of Artificial Sequence: Synthetic peptide
  Seed: AGKGGTGVM (PTEN R130G)
AQKGGTGVV

SEQ ID NO: 17520 - protein, 9 aa, Artificial Sequence
  Description of Artificial Sequence: Synthetic peptide
  Seed: AGKGGTGVM (PTEN R130G)
AQKGGTGVW

SEQ ID NO: 17521 - protein, 9 aa, Artificial Sequence
  Description of Artificial Sequence: Synthetic peptide
  Seed: AGKGGTGVM (PTEN R130G)
AQKGGTGVY

SEQ ID NO: 17522 - protein, 9 aa, Artificial Sequence
  Description of Artificial Sequence: Synthetic peptide
  Seed: AGKGGTGVM (PTEN R130G)
ARKGGTGVA

SEQ ID NO: 17523 - protein, 9 aa, Artificial Sequence
  Description of Artificial Sequence: Synthetic peptide
  Seed: AGKGGTGVM (PTEN R130G)
ARKGGTGVC

SEQ ID NO: 17524 - protein, 9 aa, Artificial Sequence
  Description of Artificial Sequence: Synthetic peptide
  Seed: AGKGGTGVM (PTEN R130G)
ARKGGTGVF

SEQ ID NO: 17525 - protein, 9 aa, Artificial Sequence
  Description of Artificial Sequence: Synthetic peptide
  Seed: AGKGGTGVM (PTEN R130G)
ARKGGTGVH

SEQ ID NO: 17526 - protein, 9 aa, Artificial Sequence
  Description of Artificial Sequence: Synthetic peptide
  Seed: AGKGGTGVM (PTEN R130G)
ARKGGTGVI

SEQ ID NO: 17527 - protein, 9 aa, Artificial Sequence
  Description of Artificial Sequence: Synthetic peptide
  Seed: AGKGGTGVM (PTEN R130G)
ARKGGTGVK

SEQ ID NO: 17528 - protein, 9 aa, Artificial Sequence
  Description of Artificial Sequence: Synthetic peptide
  Seed: AGKGGTGVM (PTEN R130G)
ARKGGTGVL

SEQ ID NO: 17529 - protein, 9 aa, Artificial Sequence
  Description of Artificial Sequence: Synthetic peptide
  Seed: AGKGGTGVM (PTEN R130G)
ARKGGTGVM

SEQ ID NO: 17530 - protein, 9 aa, Artificial Sequence
  Description of Artificial Sequence: Synthetic peptide
  Seed: AGKGGTGVM (PTEN R130G)
ARKGGTGVR

SEQ ID NO: 17531 - protein, 9 aa, Artificial Sequence
  Description of Artificial Sequence: Synthetic peptide
  Seed: AGKGGTGVM (PTEN R130G)
ARKGGTGVV

SEQ ID NO: 17532 - protein, 9 aa, Artificial Sequence
  Description of Artificial Sequence: Synthetic peptide
  Seed: AGKGGTGVM (PTEN R130G)
ARKGGTGVW

SEQ ID NO: 17533 - protein, 9 aa, Artificial Sequence
  Description of Artificial Sequence: Synthetic peptide
  Seed: AGKGGTGVM (PTEN R130G)
ARKGGTGVY

SEQ ID NO: 17534 - protein, 9 aa, Artificial Sequence
  Description of Artificial Sequence: Synthetic peptide
  Seed: AGKGGTGVM (PTEN R130G)
ASKGGTGVA

SEQ ID NO: 17535 - protein, 9 aa, Artificial Sequence
  Description of Artificial Sequence: Synthetic peptide
  Seed: AGKGGTGVM (PTEN R130G)
ASKGGTGVC

SEQ ID NO: 17536 - protein, 9 aa, Artificial Sequence
  Description of Artificial Sequence: Synthetic peptide
  Seed: AGKGGTGVM (PTEN R130G)
ASKGGTGVF

SEQ ID NO: 17537 - protein, 9 aa, Artificial Sequence
  Description of Artificial Sequence: Synthetic peptide
  Seed: AGKGGTGVM (PTEN R130G)
ASKGGTGVH

SEQ ID NO: 17538 - protein, 9 aa, Artificial Sequence
  Description of Artificial Sequence: Synthetic peptide
  Seed: AGKGGTGVM (PTEN R130G)
ASKGGTGVI

SEQ ID NO: 17539 - protein, 9 aa, Artificial Sequence
  Description of Artificial Sequence: Synthetic peptide
  Seed: AGKGGTGVM (PTEN R130G)
ASKGGTGVK

SEQ ID NO: 17540 - protein, 9 aa, Artificial Sequence
  Description of Artificial Sequence: Synthetic peptide
  Seed: AGKGGTGVM (PTEN R130G)
ASKGGTGVL

SEQ ID NO: 17541 - protein, 9 aa, Artificial Sequence
  Description of Artificial Sequence: Synthetic peptide
  Seed: AGKGGTGVM (PTEN R130G)
ASKGGTGVM

SEQ ID NO: 17542 - protein, 9 aa, Artificial Sequence
  Description of Artificial Sequence: Synthetic peptide
  Seed: AGKGGTGVM (PTEN R130G)
ASKGGTGVP

SEQ ID NO: 17543 - protein, 9 aa, Artificial Sequence
  Description of Artificial Sequence: Synthetic peptide
  Seed: AGKGGTGVM (PTEN R130G)
ASKGGTGVQ

SEQ ID NO: 17544 - protein, 9 aa, Artificial Sequence
  Description of Artificial Sequence: Synthetic peptide
  Seed: AGKGGTGVM (PTEN R130G)
ASKGGTGVR

SEQ ID NO: 17545 - protein, 9 aa, Artificial Sequence
  Description of Artificial Sequence: Synthetic peptide
  Seed: AGKGGTGVM (PTEN R130G)
ASKGGTGVS

SEQ ID NO: 17546 - protein, 9 aa, Artificial Sequence
  Description of Artificial Sequence: Synthetic peptide
  Seed: AGKGGTGVM (PTEN R130G)
ASKGGTGVT

SEQ ID NO: 17547 - protein, 9 aa, Artificial Sequence
  Description of Artificial Sequence: Synthetic peptide
  Seed: AGKGGTGVM (PTEN R130G)
ASKGGTGVV

SEQ ID NO: 17548 - protein, 9 aa, Artificial Sequence
  Description of Artificial Sequence: Synthetic peptide
  Seed: AGKGGTGVM (PTEN R130G)
ASKGGTGVW

SEQ ID NO: 17549 - protein, 9 aa, Artificial Sequence
  Description of Artificial Sequence: Synthetic peptide
  Seed: AGKGGTGVM (PTEN R130G)
ASKGGTGVY

SEQ ID NO: 17550 - protein, 9 aa, Artificial Sequence
  Description of Artificial Sequence: Synthetic peptide
  Seed: AGKGGTGVM (PTEN R130G)
ATKGGTGVA

SEQ ID NO: 17551 - protein, 9 aa, Artificial Sequence
  Description of Artificial Sequence: Synthetic peptide
  Seed: AGKGGTGVM (PTEN R130G)
ATKGGTGVC

SEQ ID NO: 17552 - protein, 9 aa, Artificial Sequence
  Description of Artificial Sequence: Synthetic peptide
  Seed: AGKGGTGVM (PTEN R130G)
ATKGGTGVF

SEQ ID NO: 17553 - protein, 9 aa, Artificial Sequence
  Description of Artificial Sequence: Synthetic peptide
  Seed: AGKGGTGVM (PTEN R130G)
ATKGGTGVH

SEQ ID NO: 17554 - protein, 9 aa, Artificial Sequence
  Description of Artificial Sequence: Synthetic peptide
  Seed: AGKGGTGVM (PTEN R130G)
ATKGGTGVI

SEQ ID NO: 17555 - protein, 9 aa, Artificial Sequence
  Description of Artificial Sequence: Synthetic peptide
  Seed: AGKGGTGVM (PTEN R130G)
ATKGGTGVK

SEQ ID NO: 17556 - protein, 9 aa, Artificial Sequence
  Description of Artificial Sequence: Synthetic peptide
  Seed: AGKGGTGVM (PTEN R130G)
ATKGGTGVL

SEQ ID NO: 17557 - protein, 9 aa, Artificial Sequence
  Description of Artificial Sequence: Synthetic peptide
  Seed: AGKGGTGVM (PTEN R130G)
ATKGGTGVM

SEQ ID NO: 17558 - protein, 9 aa, Artificial Sequence
  Description of Artificial Sequence: Synthetic peptide
  Seed: AGKGGTGVM (PTEN R130G)
ATKGGTGVQ

SEQ ID NO: 17559 - protein, 9 aa, Artificial Sequence
  Description of Artificial Sequence: Synthetic peptide
  Seed: AGKGGTGVM (PTEN R130G)
ATKGGTGVR

SEQ ID NO: 17560 - protein, 9 aa, Artificial Sequence
  Description of Artificial Sequence: Synthetic peptide
  Seed: AGKGGTGVM (PTEN R130G)
ATKGGTGVS

SEQ ID NO: 17561 - protein, 9 aa, Artificial Sequence
  Description of Artificial Sequence: Synthetic peptide
  Seed: AGKGGTGVM (PTEN R130G)
ATKGGTGVT

SEQ ID NO: 17562 - protein, 9 aa, Artificial Sequence
  Description of Artificial Sequence: Synthetic peptide
  Seed: AGKGGTGVM (PTEN R130G)
ATKGGTGVV

SEQ ID NO: 17563 - protein, 9 aa, Artificial Sequence
  Description of Artificial Sequence: Synthetic peptide
  Seed: AGKGGTGVM (PTEN R130G)
ATKGGTGVW

SEQ ID NO: 17564 - protein, 9 aa, Artificial Sequence
  Description of Artificial Sequence: Synthetic peptide
  Seed: AGKGGTGVM (PTEN R130G)
ATKGGTGVY

SEQ ID NO: 17565 - protein, 9 aa, Artificial Sequence
  Description of Artificial Sequence: Synthetic peptide
  Seed: AGKGGTGVM (PTEN R130G)
AVKGGTGVA

SEQ ID NO: 17566 - protein, 9 aa, Artificial Sequence
  Description of Artificial Sequence: Synthetic peptide
  Seed: AGKGGTGVM (PTEN R130G)
AVKGGTGVC

SEQ ID NO: 17567 - protein, 9 aa, Artificial Sequence
  Description of Artificial Sequence: Synthetic peptide
  Seed: AGKGGTGVM (PTEN R130G)
AVKGGTGVF

SEQ ID NO: 17568 - protein, 9 aa, Artificial Sequence
  Description of Artificial Sequence: Synthetic peptide
  Seed: AGKGGTGVM (PTEN R130G)
AVKGGTGVH

SEQ ID NO: 17569 - protein, 9 aa, Artificial Sequence
  Description of Artificial Sequence: Synthetic peptide
  Seed: AGKGGTGVM (PTEN R130G)
AVKGGTGVI

SEQ ID NO: 17570 - protein, 9 aa, Artificial Sequence
  Description of Artificial Sequence: Synthetic peptide
  Seed: AGKGGTGVM (PTEN R130G)
AVKGGTGVK

SEQ ID NO: 17571 - protein, 9 aa, Artificial Sequence
  Description of Artificial Sequence: Synthetic peptide
  Seed: AGKGGTGVM (PTEN R130G)
AVKGGTGVL

SEQ ID NO: 17572 - protein, 9 aa, Artificial Sequence
  Description of Artificial Sequence: Synthetic peptide
  Seed: AGKGGTGVM (PTEN R130G)
AVKGGTGVM

SEQ ID NO: 17573 - protein, 9 aa, Artificial Sequence
  Description of Artificial Sequence: Synthetic peptide
  Seed: AGKGGTGVM (PTEN R130G)
AVKGGTGVQ

SEQ ID NO: 17574 - protein, 9 aa, Artificial Sequence
  Description of Artificial Sequence: Synthetic peptide
  Seed: AGKGGTGVM (PTEN R130G)
AVKGGTGVR

SEQ ID NO: 17575 - protein, 9 aa, Artificial Sequence
  Description of Artificial Sequence: Synthetic peptide
  Seed: AGKGGTGVM (PTEN R130G)
AVKGGTGVS

SEQ ID NO: 17576 - protein, 9 aa, Artificial Sequence
  Description of Artificial Sequence: Synthetic peptide
  Seed: AGKGGTGVM (PTEN R130G)
AVKGGTGVT

SEQ ID NO: 17577 - protein, 9 aa, Artificial Sequence
  Description of Artificial Sequence: Synthetic peptide
  Seed: AGKGGTGVM (PTEN R130G)
AVKGGTGVV

SEQ ID NO: 17578 - protein, 9 aa, Artificial Sequence
  Description of Artificial Sequence: Synthetic peptide
  Seed: AGKGGTGVM (PTEN R130G)
AVKGGTGVW

SEQ ID NO: 17579 - protein, 9 aa, Artificial Sequence
  Description of Artificial Sequence: Synthetic peptide
  Seed: AGKGGTGVM (PTEN R130G)
AVKGGTGVY

SEQ ID NO: 17580 - protein, 9 aa, Artificial Sequence
  Description of Artificial Sequence: Synthetic peptide
  Seed: AGKGGTGVM (PTEN R130G)
AWKGGTGVF

SEQ ID NO: 17581 - protein, 9 aa, Artificial Sequence
  Description of Artificial Sequence: Synthetic peptide
  Seed: AGKGGTGVM (PTEN R130G)
AWKGGTGVL

SEQ ID NO: 17582 - protein, 9 aa, Artificial Sequence
  Description of Artificial Sequence: Synthetic peptide
  Seed: AGKGGTGVM (PTEN R130G)
AWKGGTGVM

SEQ ID NO: 17583 - protein, 9 aa, Artificial Sequence
  Description of Artificial Sequence: Synthetic peptide
  Seed: AGKGGTGVM (PTEN R130G)
AWKGGTGVY

SEQ ID NO: 17584 - protein, 9 aa, Artificial Sequence
  Description of Artificial Sequence: Synthetic peptide
  Seed: AGKGGTGVM (PTEN R130G)
AYKGGTGVI

SEQ ID NO: 17585 - protein, 9 aa, Artificial Sequence
  Description of Artificial Sequence: Synthetic peptide
  Seed: AGKGGTGVM (PTEN R130G)
AYKGGTGVL

SEQ ID NO: 17586 - protein, 9 aa, Artificial Sequence
  Description of Artificial Sequence: Synthetic peptide
  Seed: AGKGGTGVM (PTEN R130G)
AYKGGTGVM

SEQ ID NO: 17587 - protein, 9 aa, Artificial Sequence
  Description of Artificial Sequence: Synthetic peptide
  Seed: AGKGGTGVM (PTEN R130G)
AYKGGTGVV

SEQ ID NO: 17588 - protein, 9 aa, Artificial Sequence
  Description of Artificial Sequence: Synthetic peptide
  Seed: AGKGGTGVM (PTEN R130G)
AYKGGTGVW

SEQ ID NO: 17589 - protein, 9 aa, Artificial Sequence
  Description of Artificial Sequence: Synthetic peptide
  Seed: AGKGGTGVM (PTEN R130G)
AYKGGTGVY

SEQ ID NO: 17590 - protein, 9 aa, Artificial Sequence
  Description of Artificial Sequence: Synthetic peptide
  Seed: GTGVMICAY (PTEN R130G)
GAGVMICAH

SEQ ID NO: 17591 - protein, 9 aa, Artificial Sequence
  Description of Artificial Sequence: Synthetic peptide
  Seed: GTGVMICAY (PTEN R130G)
GAGVMICAI

SEQ ID NO: 17592 - protein, 9 aa, Artificial Sequence
  Description of Artificial Sequence: Synthetic peptide
  Seed: GTGVMICAY (PTEN R130G)
GAGVMICAL

SEQ ID NO: 17593 - protein, 9 aa, Artificial Sequence
  Description of Artificial Sequence: Synthetic peptide
  Seed: GTGVMICAY (PTEN R130G)
GAGVMICAM

SEQ ID NO: 17594 - protein, 9 aa, Artificial Sequence
  Description of Artificial Sequence: Synthetic peptide
  Seed: GTGVMICAY (PTEN R130G)
GAGVMICAV

SEQ ID NO: 17595 - protein, 9 aa, Artificial Sequence
  Description of Artificial Sequence: Synthetic peptide
  Seed: GTGVMICAY (PTEN R130G)
GAGVMICAW

SEQ ID NO: 17596 - protein, 9 aa, Artificial Sequence
  Description of Artificial Sequence: Synthetic peptide
  Seed: GTGVMICAY (PTEN R130G)
GEGVMICAF

SEQ ID NO: 17597 - protein, 9 aa, Artificial Sequence
  Description of Artificial Sequence: Synthetic peptide
  Seed: GTGVMICAY (PTEN R130G)
GEGVMICAY

SEQ ID NO: 17598 - protein, 9 aa, Artificial Sequence
  Description of Artificial Sequence: Synthetic peptide
  Seed: GTGVMICAY (PTEN R130G)
GFGVMICAF

SEQ ID NO: 17599 - protein, 9 aa, Artificial Sequence
  Description of Artificial Sequence: Synthetic peptide
  Seed: GTGVMICAY (PTEN R130G)
GGGVMICAF

SEQ ID NO: 17600 - protein, 9 aa, Artificial Sequence
  Description of Artificial Sequence: Synthetic peptide
  Seed: GTGVMICAY (PTEN R130G)
GHGVMICAY

SEQ ID NO: 17601 - protein, 9 aa, Artificial Sequence
  Description of Artificial Sequence: Synthetic peptide
  Seed: GTGVMICAY (PTEN R130G)
GKGVMICAY

SEQ ID NO: 17602 - protein, 9 aa, Artificial Sequence
  Description of Artificial Sequence: Synthetic peptide
  Seed: GTGVMICAY (PTEN R130G)
GLGVMICAM

SEQ ID NO: 17603 - protein, 9 aa, Artificial Sequence
  Description of Artificial Sequence: Synthetic peptide
  Seed: GTGVMICAY (PTEN R130G)
GMGVMICAL

SEQ ID NO: 17604 - protein, 9 aa, Artificial Sequence
  Description of Artificial Sequence: Synthetic peptide
  Seed: GTGVMICAY (PTEN R130G)
GNGVMICAF

SEQ ID NO: 17605 - protein, 9 aa, Artificial Sequence
  Description of Artificial Sequence: Synthetic peptide
  Seed: GTGVMICAY (PTEN R130G)
GPGVMICAF

SEQ ID NO: 17606 - protein, 9 aa, Artificial Sequence
  Description of Artificial Sequence: Synthetic peptide
  Seed: GTGVMICAY (PTEN R130G)
GPGVMICAY

SEQ ID NO: 17607 - protein, 9 aa, Artificial Sequence
  Description of Artificial Sequence: Synthetic peptide
  Seed: GTGVMICAY (PTEN R130G)
GQGVMICAW

SEQ ID NO: 17608 - protein, 9 aa, Artificial Sequence
  Description of Artificial Sequence: Synthetic peptide
  Seed: GTGVMICAY (PTEN R130G)
GRGVMICAY

SEQ ID NO: 17609 - protein, 9 aa, Artificial Sequence
  Description of Artificial Sequence: Synthetic peptide
  Seed: GTGVMICAY (PTEN R130G)
GSGVMICAK

SEQ ID NO: 17610 - protein, 9 aa, Artificial Sequence
  Description of Artificial Sequence: Synthetic peptide
  Seed: GTGVMICAY (PTEN R130G)
GSGVMICAL

SEQ ID NO: 17611 - protein, 9 aa, Artificial Sequence
  Description of Artificial Sequence: Synthetic peptide
  Seed: GTGVMICAY (PTEN R130G)
GSGVMICAM

SEQ ID NO: 17612 - protein, 9 aa, Artificial Sequence
  Description of Artificial Sequence: Synthetic peptide
  Seed: GTGVMICAY (PTEN R130G)
GTGVMICAK

SEQ ID NO: 17613 - protein, 9 aa, Artificial Sequence
  Description of Artificial Sequence: Synthetic peptide
  Seed: GTGVMICAY (PTEN R130G)
GTGVMICAL

SEQ ID NO: 17614 - protein, 9 aa, Artificial Sequence
  Description of Artificial Sequence: Synthetic peptide
  Seed: GTGVMICAY (PTEN R130G)
GTGVMICAM

SEQ ID NO: 17615 - protein, 9 aa, Artificial Sequence
  Description of Artificial Sequence: Synthetic peptide
  Seed: GTGVMICAY (PTEN R130G)
GVGVMICAM

SEQ ID NO: 17616 - protein, 9 aa, Artificial Sequence
  Description of Artificial Sequence: Synthetic peptide
  Seed: KAGKGGTGV (PTEN R130G)
KAGKGGTGA

SEQ ID NO: 17617 - protein, 9 aa, Artificial Sequence
  Description of Artificial Sequence: Synthetic peptide
  Seed: KAGKGGTGV (PTEN R130G)
KAGKGGTGF

SEQ ID NO: 17618 - protein, 9 aa, Artificial Sequence
  Description of Artificial Sequence: Synthetic peptide
  Seed: KAGKGGTGV (PTEN R130G)
KAGKGGTGH

SEQ ID NO: 17619 - protein, 9 aa, Artificial Sequence
  Description of Artificial Sequence: Synthetic peptide
  Seed: KAGKGGTGV (PTEN R130G)
KAGKGGTGI

SEQ ID NO: 17620 - protein, 9 aa, Artificial Sequence
  Description of Artificial Sequence: Synthetic peptide
  Seed: KAGKGGTGV (PTEN R130G)
KAGKGGTGK

SEQ ID NO: 17621 - protein, 9 aa, Artificial Sequence
  Description of Artificial Sequence: Synthetic peptide
  Seed: KAGKGGTGV (PTEN R130G)
KAGKGGTGL

SEQ ID NO: 17622 - protein, 9 aa, Artificial Sequence
  Description of Artificial Sequence: Synthetic peptide
  Seed: KAGKGGTGV (PTEN R130G)
KAGKGGTGM

SEQ ID NO: 17623 - protein, 9 aa, Artificial Sequence
  Description of Artificial Sequence: Synthetic peptide
  Seed: KAGKGGTGV (PTEN R130G)
KAGKGGTGR

SEQ ID NO: 17624 - protein, 10 aa, Artificial Sequence
  Description of Artificial Sequence: Synthetic peptide
  Seed: KAGKGGTGVM (PTEN R130G)
KAGKGGTGVF

SEQ ID NO: 17625 - protein, 10 aa, Artificial Sequence
  Description of Artificial Sequence: Synthetic peptide
  Seed: KAGKGGTGVM (PTEN R130G)
KAGKGGTGVH

SEQ ID NO: 17626 - protein, 10 aa, Artificial Sequence
  Description of Artificial Sequence: Synthetic peptide
  Seed: KAGKGGTGVM (PTEN R130G)
KAGKGGTGVI

SEQ ID NO: 17627 - protein, 10 aa, Artificial Sequence
  Description of Artificial Sequence: Synthetic peptide
  Seed: KAGKGGTGVM (PTEN R130G)
KAGKGGTGVK

SEQ ID NO: 17628 - protein, 10 aa, Artificial Sequence
  Description of Artificial Sequence: Synthetic peptide
  Seed: KAGKGGTGVM (PTEN R130G)
KAGKGGTGVL

SEQ ID NO: 17629 - protein, 11 aa, Artificial Sequence
  Description of Artificial Sequence: Synthetic peptide
  Seed: KAGKGGTGVMI (PTEN R130G)
KAGKGGTGVMF

SEQ ID NO: 17630 - protein, 11 aa, Artificial Sequence
  Description of Artificial Sequence: Synthetic peptide
  Seed: KAGKGGTGVMI (PTEN R130G)
KAGKGGTGVMH

SEQ ID NO: 17631 - protein, 11 aa, Artificial Sequence
  Description of Artificial Sequence: Synthetic peptide
  Seed: KAGKGGTGVMI (PTEN R130G)
KAGKGGTGVMK

SEQ ID NO: 17632 - protein, 11 aa, Artificial Sequence
  Description of Artificial Sequence: Synthetic peptide
  Seed: KAGKGGTGVMI (PTEN R130G)
KAGKGGTGVML

SEQ ID NO: 17633 - protein, 11 aa, Artificial Sequence
  Description of Artificial Sequence: Synthetic peptide
  Seed: KAGKGGTGVMI (PTEN R130G)
KAGKGGTGVMM

SEQ ID NO: 17634 - protein, 11 aa, Artificial Sequence
  Description of Artificial Sequence: Synthetic peptide
  Seed: KAGKGGTGVMI (PTEN R130G)
KAGKGGTGVMR

SEQ ID NO: 17635 - protein, 11 aa, Artificial Sequence
  Description of Artificial Sequence: Synthetic peptide
  Seed: KAGKGGTGVMI (PTEN R130G)
KAGKGGTGVMV

SEQ ID NO: 17636 - protein, 11 aa, Artificial Sequence
  Description of Artificial Sequence: Synthetic peptide
  Seed: KAGKGGTGVMI (PTEN R130G)
KAGKGGTGVMY

SEQ ID NO: 17637 - protein, 10 aa, Artificial Sequence
  Description of Artificial Sequence: Synthetic peptide
  Seed: KAGKGGTGVM (PTEN R130G)
KAGKGGTGVR

SEQ ID NO: 17638 - protein, 10 aa, Artificial Sequence
  Description of Artificial Sequence: Synthetic peptide
  Seed: KAGKGGTGVM (PTEN R130G)
KAGKGGTGVV

SEQ ID NO: 17639 - protein, 10 aa, Artificial Sequence
  Description of Artificial Sequence: Synthetic peptide
  Seed: KAGKGGTGVM (PTEN R130G)
KAGKGGTGVW

SEQ ID NO: 17640 - protein, 10 aa, Artificial Sequence
  Description of Artificial Sequence: Synthetic peptide
  Seed: KAGKGGTGVM (PTEN R130G)
KAGKGGTGVY

SEQ ID NO: 17641 - protein, 9 aa, Artificial Sequence
  Description of Artificial Sequence: Synthetic peptide
  Seed: KAGKGGTGV (PTEN R130G)
KAGKGGTGW

SEQ ID NO: 17642 - protein, 9 aa, Artificial Sequence
  Description of Artificial Sequence: Synthetic peptide
  Seed: KAGKGGTGV (PTEN R130G)
KAGKGGTGY

SEQ ID NO: 17643 - protein, 11 aa, Artificial Sequence
  Description of Artificial Sequence: Synthetic peptide
  Seed: KGGTGVMICAY (PTEN R130G)
KAGTGVMICAY

SEQ ID NO: 17644 - protein, 9 aa, Artificial Sequence
  Description of Artificial Sequence: Synthetic peptide
  Seed: KAGKGGTGV (PTEN R130G)
KCGKGGTGL

SEQ ID NO: 17645 - protein, 11 aa, Artificial Sequence
  Description of Artificial Sequence: Synthetic peptide
  Seed: KAGKGGTGVMI (PTEN R130G)
KCGKGGTGVMF

SEQ ID NO: 17646 - protein, 11 aa, Artificial Sequence
  Description of Artificial Sequence: Synthetic peptide
  Seed: KAGKGGTGVMI (PTEN R130G)
KCGKGGTGVMW

SEQ ID NO: 17647 - protein, 11 aa, Artificial Sequence
  Description of Artificial Sequence: Synthetic peptide
  Seed: KAGKGGTGVMI (PTEN R130G)
KCGKGGTGVMY

SEQ ID NO: 17648 - protein, 10 aa, Artificial Sequence
  Description of Artificial Sequence: Synthetic peptide
  Seed: KAGKGGTGVM (PTEN R130G)
KCGKGGTGVY

SEQ ID NO: 17649 - protein, 9 aa, Artificial Sequence
  Description of Artificial Sequence: Synthetic peptide
  Seed: KAGKGGTGV (PTEN R130G)
KCGKGGTGY

SEQ ID NO: 17650 - protein, 11 aa, Artificial Sequence
  Description of Artificial Sequence: Synthetic peptide
  Seed: KAGKGGTGVMI (PTEN R130G)
KDGKGGTGVMW

SEQ ID NO: 17651 - protein, 9 aa, Artificial Sequence
  Description of Artificial Sequence: Synthetic peptide
  Seed: KAGKGGTGV (PTEN R130G)
KEGKGGTGI

SEQ ID NO: 17652 - protein, 9 aa, Artificial Sequence
  Description of Artificial Sequence: Synthetic peptide
  Seed: KAGKGGTGV (PTEN R130G)
KEGKGGTGL

SEQ ID NO: 17653 - protein, 9 aa, Artificial Sequence
  Description of Artificial Sequence: Synthetic peptide
  Seed: KAGKGGTGV (PTEN R130G)
KEGKGGTGV

SEQ ID NO: 17654 - protein, 10 aa, Artificial Sequence
  Description of Artificial Sequence: Synthetic peptide
  Seed: KAGKGGTGVM (PTEN R130G)
KEGKGGTGVF

SEQ ID NO: 17655 - protein, 11 aa, Artificial Sequence
  Description of Artificial Sequence: Synthetic peptide
  Seed: KAGKGGTGVMI (PTEN R130G)
KEGKGGTGVMF

SEQ ID NO: 17656 - protein, 11 aa, Artificial Sequence
  Description of Artificial Sequence: Synthetic peptide
  Seed: KAGKGGTGVMI (PTEN R130G)
KEGKGGTGVMI

SEQ ID NO: 17657 - protein, 11 aa, Artificial Sequence
  Description of Artificial Sequence: Synthetic peptide
  Seed: KAGKGGTGVMI (PTEN R130G)
KEGKGGTGVML

SEQ ID NO: 17658 - protein, 11 aa, Artificial Sequence
  Description of Artificial Sequence: Synthetic peptide
  Seed: KAGKGGTGVMI (PTEN R130G)
KEGKGGTGVMM

SEQ ID NO: 17659 - protein, 11 aa, Artificial Sequence
  Description of Artificial Sequence: Synthetic peptide
  Seed: KAGKGGTGVMI (PTEN R130G)
KEGKGGTGVMV

SEQ ID NO: 17660 - protein, 11 aa, Artificial Sequence
  Description of Artificial Sequence: Synthetic peptide
  Seed: KAGKGGTGVMI (PTEN R130G)
KEGKGGTGVMW

SEQ ID NO: 17661 - protein, 11 aa, Artificial Sequence
  Description of Artificial Sequence: Synthetic peptide
  Seed: KAGKGGTGVMI (PTEN R130G)
KEGKGGTGVMY

SEQ ID NO: 17662 - protein, 10 aa, Artificial Sequence
  Description of Artificial Sequence: Synthetic peptide
  Seed: KAGKGGTGVM (PTEN R130G)
KEGKGGTGVY

SEQ ID NO: 17663 - protein, 9 aa, Artificial Sequence
  Description of Artificial Sequence: Synthetic peptide
  Seed: KAGKGGTGV (PTEN R130G)
KEGKGGTGY

SEQ ID NO: 17664 - protein, 9 aa, Artificial Sequence
  Description of Artificial Sequence: Synthetic peptide
  Seed: KAGKGGTGV (PTEN R130G)
KFGKGGTGF

SEQ ID NO: 17665 - protein, 9 aa, Artificial Sequence
  Description of Artificial Sequence: Synthetic peptide
  Seed: KAGKGGTGV (PTEN R130G)
KFGKGGTGL

SEQ ID NO: 17666 - protein, 9 aa, Artificial Sequence
  Description of Artificial Sequence: Synthetic peptide
  Seed: KAGKGGTGV (PTEN R130G)
KFGKGGTGM

SEQ ID NO: 17667 - protein, 11 aa, Artificial Sequence
  Description of Artificial Sequence: Synthetic peptide
  Seed: KAGKGGTGVMI (PTEN R130G)
KFGKGGTGVMW

SEQ ID NO: 17668 - protein, 11 aa, Artificial Sequence
  Description of Artificial Sequence: Synthetic peptide
  Seed: KGGTGVMICAY (PTEN R130G)
KFGTGVMICAY

SEQ ID NO: 17669 - protein, 9 aa, Artificial Sequence
  Description of Artificial Sequence: Synthetic peptide
  Seed: KAGKGGTGV (PTEN R130G)
KGGKGGTGF

SEQ ID NO: 17670 - protein, 9 aa, Artificial Sequence
  Description of Artificial Sequence: Synthetic peptide
  Seed: KAGKGGTGV (PTEN R130G)
KGGKGGTGK

SEQ ID NO: 17671 - protein, 9 aa, Artificial Sequence
  Description of Artificial Sequence: Synthetic peptide
  Seed: KAGKGGTGV (PTEN R130G)
KGGKGGTGL

SEQ ID NO: 17672 - protein, 9 aa, Artificial Sequence
  Description of Artificial Sequence: Synthetic peptide
  Seed: KAGKGGTGV (PTEN R130G)
KGGKGGTGM

SEQ ID NO: 17673 - protein, 9 aa, Artificial Sequence
  Description of Artificial Sequence: Synthetic peptide
  Seed: KAGKGGTGV (PTEN R130G)
KGGKGGTGR

SEQ ID NO: 17674 - protein, 10 aa, Artificial Sequence
  Description of Artificial Sequence: Synthetic peptide
  Seed: KAGKGGTGVM (PTEN R130G)
KGGKGGTGVF

SEQ ID NO: 17675 - protein, 11 aa, Artificial Sequence
  Description of Artificial Sequence: Synthetic peptide
  Seed: KAGKGGTGVMI (PTEN R130G)
KGGKGGTGVMF

SEQ ID NO: 17676 - protein, 11 aa, Artificial Sequence
  Description of Artificial Sequence: Synthetic peptide
  Seed: KAGKGGTGVMI (PTEN R130G)
KGGKGGTGVMK

SEQ ID NO: 17677 - protein, 11 aa, Artificial Sequence
  Description of Artificial Sequence: Synthetic peptide
  Seed: KAGKGGTGVMI (PTEN R130G)
KGGKGGTGVML

SEQ ID NO: 17678 - protein, 11 aa, Artificial Sequence
  Description of Artificial Sequence: Synthetic peptide
  Seed: KAGKGGTGVMI (PTEN R130G)
KGGKGGTGVMR

SEQ ID NO: 17679 - protein, 11 aa, Artificial Sequence
  Description of Artificial Sequence: Synthetic peptide
  Seed: KAGKGGTGVMI (PTEN R130G)
KGGKGGTGVMW

SEQ ID NO: 17680 - protein, 11 aa, Artificial Sequence
  Description of Artificial Sequence: Synthetic peptide
  Seed: KAGKGGTGVMI (PTEN R130G)
KGGKGGTGVMY

SEQ ID NO: 17681 - protein, 10 aa, Artificial Sequence
  Description of Artificial Sequence: Synthetic peptide
  Seed: KAGKGGTGVM (PTEN R130G)
KGGKGGTGVY

SEQ ID NO: 17682 - protein, 9 aa, Artificial Sequence
  Description of Artificial Sequence: Synthetic peptide
  Seed: KAGKGGTGV (PTEN R130G)
KGGKGGTGY

SEQ ID NO: 17683 - protein, 9 aa, Artificial Sequence
  Description of Artificial Sequence: Synthetic peptide
  Seed: KAGKGGTGV (PTEN R130G)
KHGKGGTGL

SEQ ID NO: 17684 - protein, 9 aa, Artificial Sequence
  Description of Artificial Sequence: Synthetic peptide
  Seed: KAGKGGTGV (PTEN R130G)
KHGKGGTGM

SEQ ID NO: 17685 - protein, 9 aa, Artificial Sequence
  Description of Artificial Sequence: Synthetic peptide
  Seed: KAGKGGTGV (PTEN R130G)
KIGKGGTGA

SEQ ID NO: 17686 - protein, 9 aa, Artificial Sequence
  Description of Artificial Sequence: Synthetic peptide
  Seed: KAGKGGTGV (PTEN R130G)
KIGKGGTGF

SEQ ID NO: 17687 - protein, 9 aa, Artificial Sequence
  Description of Artificial Sequence: Synthetic peptide
  Seed: KAGKGGTGV (PTEN R130G)
KIGKGGTGI

SEQ ID NO: 17688 - protein, 9 aa, Artificial Sequence
  Description of Artificial Sequence: Synthetic peptide
  Seed: KAGKGGTGV (PTEN R130G)
KIGKGGTGK

SEQ ID NO: 17689 - protein, 9 aa, Artificial Sequence
  Description of Artificial Sequence: Synthetic peptide
  Seed: KAGKGGTGV (PTEN R130G)
KIGKGGTGL

SEQ ID NO: 17690 - protein, 9 aa, Artificial Sequence
  Description of Artificial Sequence: Synthetic peptide
  Seed: KAGKGGTGV (PTEN R130G)
KIGKGGTGM

SEQ ID NO: 17691 - protein, 9 aa, Artificial Sequence
  Description of Artificial Sequence: Synthetic peptide
  Seed: KAGKGGTGV (PTEN R130G)
KIGKGGTGR

SEQ ID NO: 17692 - protein, 9 aa, Artificial Sequence
  Description of Artificial Sequence: Synthetic peptide
  Seed: KAGKGGTGV (PTEN R130G)
KIGKGGTGV

SEQ ID NO: 17693 - protein, 10 aa, Artificial Sequence
  Description of Artificial Sequence: Synthetic peptide
  Seed: KAGKGGTGVM (PTEN R130G)
KIGKGGTGVF

SEQ ID NO: 17694 - protein, 10 aa, Artificial Sequence
  Description of Artificial Sequence: Synthetic peptide
  Seed: KAGKGGTGVM (PTEN R130G)
KIGKGGTGVK

SEQ ID NO: 17695 - protein, 10 aa, Artificial Sequence
  Description of Artificial Sequence: Synthetic peptide
  Seed: KAGKGGTGVM (PTEN R130G)
KIGKGGTGVL

SEQ ID NO: 17696 - protein, 10 aa, Artificial Sequence
  Description of Artificial Sequence: Synthetic peptide
  Seed: KAGKGGTGVM (PTEN R130G)
KIGKGGTGVM

SEQ ID NO: 17697 - protein, 11 aa, Artificial Sequence
  Description of Artificial Sequence: Synthetic peptide
  Seed: KAGKGGTGVMI (PTEN R130G)
KIGKGGTGVMF

SEQ ID NO: 17698 - protein, 11 aa, Artificial Sequence
  Description of Artificial Sequence: Synthetic peptide
  Seed: KAGKGGTGVMI (PTEN R130G)
KIGKGGTGVMH

SEQ ID NO: 17699 - protein, 11 aa, Artificial Sequence
  Description of Artificial Sequence: Synthetic peptide
  Seed: KAGKGGTGVMI (PTEN R130G)
KIGKGGTGVMI

SEQ ID NO: 17700 - protein, 11 aa, Artificial Sequence
  Description of Artificial Sequence: Synthetic peptide
  Seed: KAGKGGTGVMI (PTEN R130G)
KIGKGGTGVMK

SEQ ID NO: 17701 - protein, 11 aa, Artificial Sequence
  Description of Artificial Sequence: Synthetic peptide
  Seed: KAGKGGTGVMI (PTEN R130G)
KIGKGGTGVML

SEQ ID NO: 17702 - protein, 11 aa, Artificial Sequence
  Description of Artificial Sequence: Synthetic peptide
  Seed: KAGKGGTGVMI (PTEN R130G)
KIGKGGTGVMM

SEQ ID NO: 17703 - protein, 11 aa, Artificial Sequence
  Description of Artificial Sequence: Synthetic peptide
  Seed: KAGKGGTGVMI (PTEN R130G)
KIGKGGTGVMR

SEQ ID NO: 17704 - protein, 11 aa, Artificial Sequence
  Description of Artificial Sequence: Synthetic peptide
  Seed: KAGKGGTGVMI (PTEN R130G)
KIGKGGTGVMV

SEQ ID NO: 17705 - protein, 11 aa, Artificial Sequence
  Description of Artificial Sequence: Synthetic peptide
  Seed: KAGKGGTGVMI (PTEN R130G)
KIGKGGTGVMW

SEQ ID NO: 17706 - protein, 11 aa, Artificial Sequence
  Description of Artificial Sequence: Synthetic peptide
  Seed: KAGKGGTGVMI (PTEN R130G)
KIGKGGTGVMY

SEQ ID NO: 17707 - protein, 10 aa, Artificial Sequence
  Description of Artificial Sequence: Synthetic peptide
  Seed: KAGKGGTGVM (PTEN R130G)
KIGKGGTGVR

SEQ ID NO: 17708 - protein, 10 aa, Artificial Sequence
  Description of Artificial Sequence: Synthetic peptide
  Seed: KAGKGGTGVM (PTEN R130G)
KIGKGGTGVY

SEQ ID NO: 17709 - protein, 9 aa, Artificial Sequence
  Description of Artificial Sequence: Synthetic peptide
  Seed: KAGKGGTGV (PTEN R130G)
KIGKGGTGY

SEQ ID NO: 17710 - protein, 11 aa, Artificial Sequence
  Description of Artificial Sequence: Synthetic peptide
  Seed: KGGTGVMICAY (PTEN R130G)
KIGTGVMICAY

SEQ ID NO: 17711 - protein, 9 aa, Artificial Sequence
  Description of Artificial Sequence: Synthetic peptide
  Seed: KAGKGGTGV (PTEN R130G)
KLGKGGTGA

SEQ ID NO: 17712 - protein, 9 aa, Artificial Sequence
  Description of Artificial Sequence: Synthetic peptide
  Seed: KAGKGGTGV (PTEN R130G)
KLGKGGTGF

SEQ ID NO: 17713 - protein, 9 aa, Artificial Sequence
  Description of Artificial Sequence: Synthetic peptide
  Seed: KAGKGGTGV (PTEN R130G)
KLGKGGTGI

SEQ ID NO: 17714 - protein, 9 aa, Artificial Sequence
  Description of Artificial Sequence: Synthetic peptide
  Seed: KAGKGGTGV (PTEN R130G)
KLGKGGTGL

SEQ ID NO: 17715 - protein, 9 aa, Artificial Sequence
  Description of Artificial Sequence: Synthetic peptide
  Seed: KAGKGGTGV (PTEN R130G)
KLGKGGTGM

SEQ ID NO: 17716 - protein, 9 aa, Artificial Sequence
  Description of Artificial Sequence: Synthetic peptide
  Seed: KAGKGGTGV (PTEN R130G)
KLGKGGTGV

SEQ ID NO: 17717 - protein, 10 aa, Artificial Sequence
  Description of Artificial Sequence: Synthetic peptide
  Seed: KAGKGGTGVM (PTEN R130G)
KLGKGGTGVF

SEQ ID NO: 17718 - protein, 10 aa, Artificial Sequence
  Description of Artificial Sequence: Synthetic peptide
  Seed: KAGKGGTGVM (PTEN R130G)
KLGKGGTGVL

SEQ ID NO: 17719 - protein, 11 aa, Artificial Sequence
  Description of Artificial Sequence: Synthetic peptide
  Seed: KAGKGGTGVMI (PTEN R130G)
KLGKGGTGVMC

SEQ ID NO: 17720 - protein, 11 aa, Artificial Sequence
  Description of Artificial Sequence: Synthetic peptide
  Seed: KAGKGGTGVMI (PTEN R130G)
KLGKGGTGVMF

SEQ ID NO: 17721 - protein, 11 aa, Artificial Sequence
  Description of Artificial Sequence: Synthetic peptide
  Seed: KAGKGGTGVMI (PTEN R130G)
KLGKGGTGVMI

SEQ ID NO: 17722 - protein, 11 aa, Artificial Sequence
  Description of Artificial Sequence: Synthetic peptide
  Seed: KAGKGGTGVMI (PTEN R130G)
KLGKGGTGVML

SEQ ID NO: 17723 - protein, 11 aa, Artificial Sequence
  Description of Artificial Sequence: Synthetic peptide
  Seed: KAGKGGTGVMI (PTEN R130G)
KLGKGGTGVMM

SEQ ID NO: 17724 - protein, 11 aa, Artificial Sequence
  Description of Artificial Sequence: Synthetic peptide
  Seed: KAGKGGTGVMI (PTEN R130G)
KLGKGGTGVMV

SEQ ID NO: 17725 - protein, 11 aa, Artificial Sequence
  Description of Artificial Sequence: Synthetic peptide
  Seed: KAGKGGTGVMI (PTEN R130G)
KLGKGGTGVMW

SEQ ID NO: 17726 - protein, 11 aa, Artificial Sequence
  Description of Artificial Sequence: Synthetic peptide
  Seed: KAGKGGTGVMI (PTEN R130G)
KLGKGGTGVMY

SEQ ID NO: 17727 - protein, 10 aa, Artificial Sequence
  Description of Artificial Sequence: Synthetic peptide
  Seed: KAGKGGTGVM (PTEN R130G)
KLGKGGTGVY

SEQ ID NO: 17728 - protein, 9 aa, Artificial Sequence
  Description of Artificial Sequence: Synthetic peptide
  Seed: KAGKGGTGV (PTEN R130G)
KLGKGGTGY

SEQ ID NO: 17729 - protein, 11 aa, Artificial Sequence
  Description of Artificial Sequence: Synthetic peptide
  Seed: KGGTGVMICAY (PTEN R130G)
KLGTGVMICAY

SEQ ID NO: 17730 - protein, 9 aa, Artificial Sequence
  Description of Artificial Sequence: Synthetic peptide
  Seed: KAGKGGTGV (PTEN R130G)
KMGKGGTGA

SEQ ID NO: 17731 - protein, 9 aa, Artificial Sequence
  Description of Artificial Sequence: Synthetic peptide
  Seed: KAGKGGTGV (PTEN R130G)
KMGKGGTGF

SEQ ID NO: 17732 - protein, 9 aa, Artificial Sequence
  Description of Artificial Sequence: Synthetic peptide
  Seed: KAGKGGTGV (PTEN R130G)
KMGKGGTGI

SEQ ID NO: 17733 - protein, 9 aa, Artificial Sequence
  Description of Artificial Sequence: Synthetic peptide
  Seed: KAGKGGTGV (PTEN R130G)
KMGKGGTGL

SEQ ID NO: 17734 - protein, 9 aa, Artificial Sequence
  Description of Artificial Sequence: Synthetic peptide
  Seed: KAGKGGTGV (PTEN R130G)
KMGKGGTGM

SEQ ID NO: 17735 - protein, 10 aa, Artificial Sequence
  Description of Artificial Sequence: Synthetic peptide
  Seed: KAGKGGTGVM (PTEN R130G)
KMGKGGTGVF

SEQ ID NO: 17736 - protein, 10 aa, Artificial Sequence
  Description of Artificial Sequence: Synthetic peptide
  Seed: KAGKGGTGVM (PTEN R130G)
KMGKGGTGVL

SEQ ID NO: 17737 - protein, 10 aa, Artificial Sequence
  Description of Artificial Sequence: Synthetic peptide
  Seed: KAGKGGTGVM (PTEN R130G)
KMGKGGTGVM

SEQ ID NO: 17738 - protein, 11 aa, Artificial Sequence
  Description of Artificial Sequence: Synthetic peptide
  Seed: KAGKGGTGVMI (PTEN R130G)
KMGKGGTGVMC

SEQ ID NO: 17739 - protein, 11 aa, Artificial Sequence
  Description of Artificial Sequence: Synthetic peptide
  Seed: KAGKGGTGVMI (PTEN R130G)
KMGKGGTGVMF

SEQ ID NO: 17740 - protein, 11 aa, Artificial Sequence
  Description of Artificial Sequence: Synthetic peptide
  Seed: KAGKGGTGVMI (PTEN R130G)
KMGKGGTGVMI

SEQ ID NO: 17741 - protein, 11 aa, Artificial Sequence
  Description of Artificial Sequence: Synthetic peptide
  Seed: KAGKGGTGVMI (PTEN R130G)
KMGKGGTGVML

SEQ ID NO: 17742 - protein, 11 aa, Artificial Sequence
  Description of Artificial Sequence: Synthetic peptide
  Seed: KAGKGGTGVMI (PTEN R130G)
KMGKGGTGVMM

SEQ ID NO: 17743 - protein, 11 aa, Artificial Sequence
  Description of Artificial Sequence: Synthetic peptide
  Seed: KAGKGGTGVMI (PTEN R130G)
KMGKGGTGVMV

SEQ ID NO: 17744 - protein, 11 aa, Artificial Sequence
  Description of Artificial Sequence: Synthetic peptide
  Seed: KAGKGGTGVMI (PTEN R130G)
KMGKGGTGVMW

SEQ ID NO: 17745 - protein, 11 aa, Artificial Sequence
  Description of Artificial Sequence: Synthetic peptide
  Seed: KAGKGGTGVMI (PTEN R130G)
KMGKGGTGVMY

SEQ ID NO: 17746 - protein, 10 aa, Artificial Sequence
  Description of Artificial Sequence: Synthetic peptide
  Seed: KAGKGGTGVM (PTEN R130G)
KMGKGGTGVY

SEQ ID NO: 17747 - protein, 9 aa, Artificial Sequence
  Description of Artificial Sequence: Synthetic peptide
  Seed: KAGKGGTGV (PTEN R130G)
KMGKGGTGY

SEQ ID NO: 17748 - protein, 11 aa, Artificial Sequence
  Description of Artificial Sequence: Synthetic peptide
  Seed: KGGTGVMICAY (PTEN R130G)
KMGTGVMICAY

SEQ ID NO: 17749 - protein, 9 aa, Artificial Sequence
  Description of Artificial Sequence: Synthetic peptide
  Seed: KAGKGGTGV (PTEN R130G)
KNGKGGTGL

SEQ ID NO: 17750 - protein, 11 aa, Artificial Sequence
  Description of Artificial Sequence: Synthetic peptide
  Seed: KAGKGGTGVMI (PTEN R130G)
KNGKGGTGVMF

SEQ ID NO: 17751 - protein, 11 aa, Artificial Sequence
  Description of Artificial Sequence: Synthetic peptide
  Seed: KAGKGGTGVMI (PTEN R130G)
KNGKGGTGVMW

SEQ ID NO: 17752 - protein, 10 aa, Artificial Sequence
  Description of Artificial Sequence: Synthetic peptide
  Seed: KAGKGGTGVM (PTEN R130G)
KNGKGGTGVY

SEQ ID NO: 17753 - protein, 9 aa, Artificial Sequence
  Description of Artificial Sequence: Synthetic peptide
  Seed: KAGKGGTGV (PTEN R130G)
KNGKGGTGY

SEQ ID NO: 17754 - protein, 11 aa, Artificial Sequence
  Description of Artificial Sequence: Synthetic peptide
  Seed: KGGTGVMICAY (PTEN R130G)
KNGTGVMICAY

SEQ ID NO: 17755 - protein, 11 aa, Artificial Sequence
  Description of Artificial Sequence: Synthetic peptide
  Seed: KAGKGGTGVMI (PTEN R130G)
KPGKGGTGVMW

SEQ ID NO: 17756 - protein, 9 aa, Artificial Sequence
  Description of Artificial Sequence: Synthetic peptide
  Seed: KAGKGGTGV (PTEN R130G)
KPGKGGTGY

SEQ ID NO: 17757 - protein, 9 aa, Artificial Sequence
  Description of Artificial Sequence: Synthetic peptide
  Seed: KAGKGGTGV (PTEN R130G)
KQGKGGTGF

SEQ ID NO: 17758 - protein, 9 aa, Artificial Sequence
  Description of Artificial Sequence: Synthetic peptide
  Seed: KAGKGGTGV (PTEN R130G)
KQGKGGTGI

SEQ ID NO: 17759 - protein, 9 aa, Artificial Sequence
  Description of Artificial Sequence: Synthetic peptide
  Seed: KAGKGGTGV (PTEN R130G)
KQGKGGTGL

SEQ ID NO: 17760 - protein, 9 aa, Artificial Sequence
  Description of Artificial Sequence: Synthetic peptide
  Seed: KAGKGGTGV (PTEN R130G)
KQGKGGTGM

SEQ ID NO: 17761 - protein, 9 aa, Artificial Sequence
  Description of Artificial Sequence: Synthetic peptide
  Seed: KAGKGGTGV (PTEN R130G)
KQGKGGTGV

SEQ ID NO: 17762 - protein, 10 aa, Artificial Sequence
  Description of Artificial Sequence: Synthetic peptide
  Seed: KAGKGGTGVM (PTEN R130G)
KQGKGGTGVF

SEQ ID NO: 17763 - protein, 11 aa, Artificial Sequence
  Description of Artificial Sequence: Synthetic peptide
  Seed: KAGKGGTGVMI (PTEN R130G)
KQGKGGTGVMA

SEQ ID NO: 17764 - protein, 11 aa, Artificial Sequence
  Description of Artificial Sequence: Synthetic peptide
  Seed: KAGKGGTGVMI (PTEN R130G)
KQGKGGTGVMC

SEQ ID NO: 17765 - protein, 11 aa, Artificial Sequence
  Description of Artificial Sequence: Synthetic peptide
  Seed: KAGKGGTGVMI (PTEN R130G)
KQGKGGTGVMF

SEQ ID NO: 17766 - protein, 11 aa, Artificial Sequence
  Description of Artificial Sequence: Synthetic peptide
  Seed: KAGKGGTGVMI (PTEN R130G)
KQGKGGTGVMI

SEQ ID NO: 17767 - protein, 11 aa, Artificial Sequence
  Description of Artificial Sequence: Synthetic peptide
  Seed: KAGKGGTGVMI (PTEN R130G)
KQGKGGTGVML

SEQ ID NO: 17768 - protein, 11 aa, Artificial Sequence
  Description of Artificial Sequence: Synthetic peptide
  Seed: KAGKGGTGVMI (PTEN R130G)
KQGKGGTGVMM

SEQ ID NO: 17769 - protein, 11 aa, Artificial Sequence
  Description of Artificial Sequence: Synthetic peptide
  Seed: KAGKGGTGVMI (PTEN R130G)
KQGKGGTGVMV

SEQ ID NO: 17770 - protein, 11 aa, Artificial Sequence
  Description of Artificial Sequence: Synthetic peptide
  Seed: KAGKGGTGVMI (PTEN R130G)
KQGKGGTGVMW

SEQ ID NO: 17771 - protein, 11 aa, Artificial Sequence
  Description of Artificial Sequence: Synthetic peptide
  Seed: KAGKGGTGVMI (PTEN R130G)
KQGKGGTGVMY

SEQ ID NO: 17772 - protein, 10 aa, Artificial Sequence
  Description of Artificial Sequence: Synthetic peptide
  Seed: KAGKGGTGVM (PTEN R130G)
KQGKGGTGVY

SEQ ID NO: 17773 - protein, 9 aa, Artificial Sequence
  Description of Artificial Sequence: Synthetic peptide
  Seed: KAGKGGTGV (PTEN R130G)
KQGKGGTGY

SEQ ID NO: 17774 - protein, 11 aa, Artificial Sequence
  Description of Artificial Sequence: Synthetic peptide
  Seed: KGGTGVMICAY (PTEN R130G)
KQGTGVMICAY

SEQ ID NO: 17775 - protein, 9 aa, Artificial Sequence
  Description of Artificial Sequence: Synthetic peptide
  Seed: KAGKGGTGV (PTEN R130G)
KRGKGGTGF

SEQ ID NO: 17776 - protein, 9 aa, Artificial Sequence
  Description of Artificial Sequence: Synthetic peptide
  Seed: KAGKGGTGV (PTEN R130G)
KRGKGGTGI

SEQ ID NO: 17777 - protein, 9 aa, Artificial Sequence
  Description of Artificial Sequence: Synthetic peptide
  Seed: KAGKGGTGV (PTEN R130G)
KRGKGGTGL

SEQ ID NO: 17778 - protein, 9 aa, Artificial Sequence
  Description of Artificial Sequence: Synthetic peptide
  Seed: KAGKGGTGV (PTEN R130G)
KRGKGGTGM

SEQ ID NO: 17779 - protein, 9 aa, Artificial Sequence
  Description of Artificial Sequence: Synthetic peptide
  Seed: KAGKGGTGV (PTEN R130G)
KRGKGGTGV

SEQ ID NO: 17780 - protein, 9 aa, Artificial Sequence
  Description of Artificial Sequence: Synthetic peptide
  Seed: KAGKGGTGV (PTEN R130G)
KSGKGGTGF

SEQ ID NO: 17781 - protein, 9 aa, Artificial Sequence
  Description of Artificial Sequence: Synthetic peptide
  Seed: KAGKGGTGV (PTEN R130G)
KSGKGGTGH

SEQ ID NO: 17782 - protein, 9 aa, Artificial Sequence
  Description of Artificial Sequence: Synthetic peptide
  Seed: KAGKGGTGV (PTEN R130G)
KSGKGGTGI

SEQ ID NO: 17783 - protein, 9 aa, Artificial Sequence
  Description of Artificial Sequence: Synthetic peptide
  Seed: KAGKGGTGV (PTEN R130G)
KSGKGGTGL

SEQ ID NO: 17784 - protein, 9 aa, Artificial Sequence
  Description of Artificial Sequence: Synthetic peptide
  Seed: KAGKGGTGV (PTEN R130G)
KSGKGGTGM

SEQ ID NO: 17785 - protein, 9 aa, Artificial Sequence
  Description of Artificial Sequence: Synthetic peptide
  Seed: KAGKGGTGV (PTEN R130G)
KSGKGGTGV

SEQ ID NO: 17786 - protein, 10 aa, Artificial Sequence
  Description of Artificial Sequence: Synthetic peptide
  Seed: KAGKGGTGVM (PTEN R130G)
KSGKGGTGVF

SEQ ID NO: 17787 - protein, 10 aa, Artificial Sequence
  Description of Artificial Sequence: Synthetic peptide
  Seed: KAGKGGTGVM (PTEN R130G)
KSGKGGTGVH

SEQ ID NO: 17788 - protein, 10 aa, Artificial Sequence
  Description of Artificial Sequence: Synthetic peptide
  Seed: KAGKGGTGVM (PTEN R130G)
KSGKGGTGVI

SEQ ID NO: 17789 - protein, 10 aa, Artificial Sequence
  Description of Artificial Sequence: Synthetic peptide
  Seed: KAGKGGTGVM (PTEN R130G)
KSGKGGTGVL

SEQ ID NO: 17790 - protein, 10 aa, Artificial Sequence
  Description of Artificial Sequence: Synthetic peptide
  Seed: KAGKGGTGVM (PTEN R130G)
KSGKGGTGVM

SEQ ID NO: 17791 - protein, 11 aa, Artificial Sequence
  Description of Artificial Sequence: Synthetic peptide
  Seed: KAGKGGTGVMI (PTEN R130G)
KSGKGGTGVMF

SEQ ID NO: 17792 - protein, 11 aa, Artificial Sequence
  Description of Artificial Sequence: Synthetic peptide
  Seed: KAGKGGTGVMI (PTEN R130G)
KSGKGGTGVMH

SEQ ID NO: 17793 - protein, 11 aa, Artificial Sequence
  Description of Artificial Sequence: Synthetic peptide
  Seed: KAGKGGTGVMI (PTEN R130G)
KSGKGGTGVMI

SEQ ID NO: 17794 - protein, 11 aa, Artificial Sequence
  Description of Artificial Sequence: Synthetic peptide
  Seed: KAGKGGTGVMI (PTEN R130G)
KSGKGGTGVMK

SEQ ID NO: 17795 - protein, 11 aa, Artificial Sequence
  Description of Artificial Sequence: Synthetic peptide
  Seed: KAGKGGTGVMI (PTEN R130G)
KSGKGGTGVML

SEQ ID NO: 17796 - protein, 11 aa, Artificial Sequence
  Description of Artificial Sequence: Synthetic peptide
  Seed: KAGKGGTGVMI (PTEN R130G)
KSGKGGTGVMM

SEQ ID NO: 17797 - protein, 11 aa, Artificial Sequence
  Description of Artificial Sequence: Synthetic peptide
  Seed: KAGKGGTGVMI (PTEN R130G)
KSGKGGTGVMR

SEQ ID NO: 17798 - protein, 11 aa, Artificial Sequence
  Description of Artificial Sequence: Synthetic peptide
  Seed: KAGKGGTGVMI (PTEN R130G)
KSGKGGTGVMV

SEQ ID NO: 17799 - protein, 11 aa, Artificial Sequence
  Description of Artificial Sequence: Synthetic peptide
  Seed: KAGKGGTGVMI (PTEN R130G)
KSGKGGTGVMY

SEQ ID NO: 17800 - protein, 10 aa, Artificial Sequence
  Description of Artificial Sequence: Synthetic peptide
  Seed: KAGKGGTGVM (PTEN R130G)
KSGKGGTGVV

SEQ ID NO: 17801 - protein, 10 aa, Artificial Sequence
  Description of Artificial Sequence: Synthetic peptide
  Seed: KAGKGGTGVM (PTEN R130G)
KSGKGGTGVY

SEQ ID NO: 17802 - protein, 9 aa, Artificial Sequence
  Description of Artificial Sequence: Synthetic peptide
  Seed: KAGKGGTGV (PTEN R130G)
KSGKGGTGY

SEQ ID NO: 17803 - protein, 11 aa, Artificial Sequence
  Description of Artificial Sequence: Synthetic peptide
  Seed: KGGTGVMICAY (PTEN R130G)
KSGTGVMICAY

SEQ ID NO: 17804 - protein, 9 aa, Artificial Sequence
  Description of Artificial Sequence: Synthetic peptide
  Seed: KAGKGGTGV (PTEN R130G)
KTGKGGTGF

SEQ ID NO: 17805 - protein, 9 aa, Artificial Sequence
  Description of Artificial Sequence: Synthetic peptide
  Seed: KAGKGGTGV (PTEN R130G)
KTGKGGTGH

SEQ ID NO: 17806 - protein, 9 aa, Artificial Sequence
  Description of Artificial Sequence: Synthetic peptide
  Seed: KAGKGGTGV (PTEN R130G)
KTGKGGTGI

SEQ ID NO: 17807 - protein, 9 aa, Artificial Sequence
  Description of Artificial Sequence: Synthetic peptide
  Seed: KAGKGGTGV (PTEN R130G)
KTGKGGTGL

SEQ ID NO: 17808 - protein, 9 aa, Artificial Sequence
  Description of Artificial Sequence: Synthetic peptide
  Seed: KAGKGGTGV (PTEN R130G)
KTGKGGTGM

SEQ ID NO: 17809 - protein, 9 aa, Artificial Sequence
  Description of Artificial Sequence: Synthetic peptide
  Seed: KAGKGGTGV (PTEN R130G)
KTGKGGTGV

SEQ ID NO: 17810 - protein, 10 aa, Artificial Sequence
  Description of Artificial Sequence: Synthetic peptide
  Seed: KAGKGGTGVM (PTEN R130G)
KTGKGGTGVF

SEQ ID NO: 17811 - protein, 10 aa, Artificial Sequence
  Description of Artificial Sequence: Synthetic peptide
  Seed: KAGKGGTGVM (PTEN R130G)
KTGKGGTGVI

SEQ ID NO: 17812 - protein, 10 aa, Artificial Sequence
  Description of Artificial Sequence: Synthetic peptide
  Seed: KAGKGGTGVM (PTEN R130G)
KTGKGGTGVL

SEQ ID NO: 17813 - protein, 10 aa, Artificial Sequence
  Description of Artificial Sequence: Synthetic peptide
  Seed: KAGKGGTGVM (PTEN R130G)
KTGKGGTGVM

SEQ ID NO: 17814 - protein, 11 aa, Artificial Sequence
  Description of Artificial Sequence: Synthetic peptide
  Seed: KAGKGGTGVMI (PTEN R130G)
KTGKGGTGVMC

SEQ ID NO: 17815 - protein, 11 aa, Artificial Sequence
  Description of Artificial Sequence: Synthetic peptide
  Seed: KAGKGGTGVMI (PTEN R130G)
KTGKGGTGVMF

SEQ ID NO: 17816 - protein, 11 aa, Artificial Sequence
  Description of Artificial Sequence: Synthetic peptide
  Seed: KAGKGGTGVMI (PTEN R130G)
KTGKGGTGVMH

SEQ ID NO: 17817 - protein, 11 aa, Artificial Sequence
  Description of Artificial Sequence: Synthetic peptide
  Seed: KAGKGGTGVMI (PTEN R130G)
KTGKGGTGVMI

SEQ ID NO: 17818 - protein, 11 aa, Artificial Sequence
  Description of Artificial Sequence: Synthetic peptide
  Seed: KAGKGGTGVMI (PTEN R130G)
KTGKGGTGVMK

SEQ ID NO: 17819 - protein, 11 aa, Artificial Sequence
  Description of Artificial Sequence: Synthetic peptide
  Seed: KAGKGGTGVMI (PTEN R130G)
KTGKGGTGVML

SEQ ID NO: 17820 - protein, 11 aa, Artificial Sequence
  Description of Artificial Sequence: Synthetic peptide
  Seed: KAGKGGTGVMI (PTEN R130G)
KTGKGGTGVMM

SEQ ID NO: 17821 - protein, 11 aa, Artificial Sequence
  Description of Artificial Sequence: Synthetic peptide
  Seed: KAGKGGTGVMI (PTEN R130G)
KTGKGGTGVMR

SEQ ID NO: 17822 - protein, 11 aa, Artificial Sequence
  Description of Artificial Sequence: Synthetic peptide
  Seed: KAGKGGTGVMI (PTEN R130G)
KTGKGGTGVMV

SEQ ID NO: 17823 - protein, 11 aa, Artificial Sequence
  Description of Artificial Sequence: Synthetic peptide
  Seed: KAGKGGTGVMI (PTEN R130G)
KTGKGGTGVMY

SEQ ID NO: 17824 - protein, 10 aa, Artificial Sequence
  Description of Artificial Sequence: Synthetic peptide
  Seed: KAGKGGTGVM (PTEN R130G)
KTGKGGTGVV

SEQ ID NO: 17825 - protein, 10 aa, Artificial Sequence
  Description of Artificial Sequence: Synthetic peptide
  Seed: KAGKGGTGVM (PTEN R130G)
KTGKGGTGVY

SEQ ID NO: 17826 - protein, 9 aa, Artificial Sequence
  Description of Artificial Sequence: Synthetic peptide
  Seed: KAGKGGTGV (PTEN R130G)
KTGKGGTGY

SEQ ID NO: 17827 - protein, 11 aa, Artificial Sequence
  Description of Artificial Sequence: Synthetic peptide
  Seed: KGGTGVMICAY (PTEN R130G)
KTGTGVMICAY

SEQ ID NO: 17828 - protein, 9 aa, Artificial Sequence
  Description of Artificial Sequence: Synthetic peptide
  Seed: KAGKGGTGV (PTEN R130G)
KVGKGGTGA

SEQ ID NO: 17829 - protein, 9 aa, Artificial Sequence
  Description of Artificial Sequence: Synthetic peptide
  Seed: KAGKGGTGV (PTEN R130G)
KVGKGGTGF

SEQ ID NO: 17830 - protein, 9 aa, Artificial Sequence
  Description of Artificial Sequence: Synthetic peptide
  Seed: KAGKGGTGV (PTEN R130G)
KVGKGGTGH

SEQ ID NO: 17831 - protein, 9 aa, Artificial Sequence
  Description of Artificial Sequence: Synthetic peptide
  Seed: KAGKGGTGV (PTEN R130G)
KVGKGGTGI

SEQ ID NO: 17832 - protein, 9 aa, Artificial Sequence
  Description of Artificial Sequence: Synthetic peptide
  Seed: KAGKGGTGV (PTEN R130G)
KVGKGGTGK

SEQ ID NO: 17833 - protein, 9 aa, Artificial Sequence
  Description of Artificial Sequence: Synthetic peptide
  Seed: KAGKGGTGV (PTEN R130G)
KVGKGGTGL

SEQ ID NO: 17834 - protein, 9 aa, Artificial Sequence
  Description of Artificial Sequence: Synthetic peptide
  Seed: KAGKGGTGV (PTEN R130G)
KVGKGGTGM

SEQ ID NO: 17835 - protein, 9 aa, Artificial Sequence
  Description of Artificial Sequence: Synthetic peptide
  Seed: KAGKGGTGV (PTEN R130G)
KVGKGGTGR

SEQ ID NO: 17836 - protein, 10 aa, Artificial Sequence
  Description of Artificial Sequence: Synthetic peptide
  Seed: KAGKGGTGVM (PTEN R130G)
KVGKGGTGVF

SEQ ID NO: 17837 - protein, 10 aa, Artificial Sequence
  Description of Artificial Sequence: Synthetic peptide
  Seed: KAGKGGTGVM (PTEN R130G)
KVGKGGTGVH

SEQ ID NO: 17838 - protein, 10 aa, Artificial Sequence
  Description of Artificial Sequence: Synthetic peptide
  Seed: KAGKGGTGVM (PTEN R130G)
KVGKGGTGVK

SEQ ID NO: 17839 - protein, 10 aa, Artificial Sequence
  Description of Artificial Sequence: Synthetic peptide
  Seed: KAGKGGTGVM (PTEN R130G)
KVGKGGTGVL

SEQ ID NO: 17840 - protein, 10 aa, Artificial Sequence
  Description of Artificial Sequence: Synthetic peptide
  Seed: KAGKGGTGVM (PTEN R130G)
KVGKGGTGVM

SEQ ID NO: 17841 - protein, 11 aa, Artificial Sequence
  Description of Artificial Sequence: Synthetic peptide
  Seed: KAGKGGTGVMI (PTEN R130G)
KVGKGGTGVMF

SEQ ID NO: 17842 - protein, 11 aa, Artificial Sequence
  Description of Artificial Sequence: Synthetic peptide
  Seed: KAGKGGTGVMI (PTEN R130G)
KVGKGGTGVMH

SEQ ID NO: 17843 - protein, 11 aa, Artificial Sequence
  Description of Artificial Sequence: Synthetic peptide
  Seed: KAGKGGTGVMI (PTEN R130G)
KVGKGGTGVMI

SEQ ID NO: 17844 - protein, 11 aa, Artificial Sequence
  Description of Artificial Sequence: Synthetic peptide
  Seed: KAGKGGTGVMI (PTEN R130G)
KVGKGGTGVMK

SEQ ID NO: 17845 - protein, 11 aa, Artificial Sequence
  Description of Artificial Sequence: Synthetic peptide
  Seed: KAGKGGTGVMI (PTEN R130G)
KVGKGGTGVML

SEQ ID NO: 17846 - protein, 11 aa, Artificial Sequence
  Description of Artificial Sequence: Synthetic peptide
  Seed: KAGKGGTGVMI (PTEN R130G)
KVGKGGTGVMM

SEQ ID NO: 17847 - protein, 11 aa, Artificial Sequence
  Description of Artificial Sequence: Synthetic peptide
  Seed: KAGKGGTGVMI (PTEN R130G)
KVGKGGTGVMR

SEQ ID NO: 17848 - protein, 11 aa, Artificial Sequence
  Description of Artificial Sequence: Synthetic peptide
  Seed: KAGKGGTGVMI (PTEN R130G)
KVGKGGTGVMV

SEQ ID NO: 17849 - protein, 11 aa, Artificial Sequence
  Description of Artificial Sequence: Synthetic peptide
  Seed: KAGKGGTGVMI (PTEN R130G)
KVGKGGTGVMW

SEQ ID NO: 17850 - protein, 11 aa, Artificial Sequence
  Description of Artificial Sequence: Synthetic peptide
  Seed: KAGKGGTGVMI (PTEN R130G)
KVGKGGTGVMY

SEQ ID NO: 17851 - protein, 10 aa, Artificial Sequence
  Description of Artificial Sequence: Synthetic peptide
  Seed: KAGKGGTGVM (PTEN R130G)
KVGKGGTGVR

SEQ ID NO: 17852 - protein, 10 aa, Artificial Sequence
  Description of Artificial Sequence: Synthetic peptide
  Seed: KAGKGGTGVM (PTEN R130G)
KVGKGGTGVY

SEQ ID NO: 17853 - protein, 9 aa, Artificial Sequence
  Description of Artificial Sequence: Synthetic peptide
  Seed: KAGKGGTGV (PTEN R130G)
KVGKGGTGY

SEQ ID NO: 17854 - protein, 11 aa, Artificial Sequence
  Description of Artificial Sequence: Synthetic peptide
  Seed: KGGTGVMICAY (PTEN R130G)
KVGTGVMICAY

SEQ ID NO: 17855 - protein, 11 aa, Artificial Sequence
  Description of Artificial Sequence: Synthetic peptide
  Seed: KAGKGGTGVMI (PTEN R130G)
KWGKGGTGVMW

SEQ ID NO: 17856 - protein, 11 aa, Artificial Sequence
  Description of Artificial Sequence: Synthetic peptide
  Seed: KGGTGVMICAY (PTEN R130G)
KWGTGVMICAY

SEQ ID NO: 17857 - protein, 9 aa, Artificial Sequence
  Description of Artificial Sequence: Synthetic peptide
  Seed: KAGKGGTGV (PTEN R130G)
KYGKGGTGF

SEQ ID NO: 17858 - protein, 9 aa, Artificial Sequence
  Description of Artificial Sequence: Synthetic peptide
  Seed: KAGKGGTGV (PTEN R130G)
KYGKGGTGL

SEQ ID NO: 17859 - protein, 9 aa, Artificial Sequence
  Description of Artificial Sequence: Synthetic peptide
  Seed: KAGKGGTGV (PTEN R130G)
KYGKGGTGM

SEQ ID NO: 17860 - protein, 11 aa, Artificial Sequence
  Description of Artificial Sequence: Synthetic peptide
  Seed: KAGKGGTGVMI (PTEN R130G)
KYGKGGTGVMW

SEQ ID NO: 17861 - protein, 11 aa, Artificial Sequence
  Description of Artificial Sequence: Synthetic peptide
  Seed: KGGTGVMICAY (PTEN R130G)
KYGTGVMICAY

SEQ ID NO: 17862 - protein, 9 aa, Homo sapiens
  Native (PTEN R130G)
GTGVMICAY

SEQ ID NO: 17863 - protein, 10 aa, Homo sapiens
  Native (PTEN R130G)
GTGVMICAYL

SEQ ID NO: 17864 - protein, 9 aa, Homo sapiens
  Native (PTEN R130G)
AGKGGTGVM

SEQ ID NO: 17865 - protein, 9 aa, Homo sapiens
  Native (PTEN R130G)
KAGKGGTGV

SEQ ID NO: 17866 - protein, 10 aa, Homo sapiens
  Native (PTEN R130G)
KAGKGGTGVM

SEQ ID NO: 17867 - protein, 11 aa, Homo sapiens
  Native (PTEN R130G)
KAGKGGTGVMI

SEQ ID NO: 17868 - protein, 11 aa, Homo sapiens
  Native (PTEN R130G)
KGGTGVMICAY

SEQ ID NO: 17869 - protein, 11 aa, Artificial Sequence
  Description of Artificial Sequence: Synthetic peptide
  Seed: KGQTGVMICAY (PTEN R130Q)
KAQTGVMICAY

SEQ ID NO: 17870 - protein, 11 aa, Artificial Sequence
  Description of Artificial Sequence: Synthetic peptide
  Seed: KGQTGVMICAY (PTEN R130Q)
KFQTGVMICAY

SEQ ID NO: 17871 - protein, 11 aa, Artificial Sequence
  Description of Artificial Sequence: Synthetic peptide
  Seed: KGQTGVMICAY (PTEN R130Q)
KHQTGVMICAY

SEQ ID NO: 17872 - protein, 11 aa, Artificial Sequence
  Description of Artificial Sequence: Synthetic peptide
  Seed: KGQTGVMICAY (PTEN R130Q)
KIQTGVMICAY

SEQ ID NO: 17873 - protein, 11 aa, Artificial Sequence
  Description of Artificial Sequence: Synthetic peptide
  Seed: KGQTGVMICAY (PTEN R130Q)
KKQTGVMICAY

SEQ ID NO: 17874 - protein, 11 aa, Artificial Sequence
  Description of Artificial Sequence: Synthetic peptide
  Seed: KGQTGVMICAY (PTEN R130Q)
KLQTGVMICAY

SEQ ID NO: 17875 - protein, 11 aa, Artificial Sequence
  Description of Artificial Sequence: Synthetic peptide
  Seed: KGQTGVMICAY (PTEN R130Q)
KMQTGVMICAY

SEQ ID NO: 17876 - protein, 11 aa, Artificial Sequence
  Description of Artificial Sequence: Synthetic peptide
  Seed: KGQTGVMICAY (PTEN R130Q)
KNQTGVMICAY

SEQ ID NO: 17877 - protein, 11 aa, Artificial Sequence
  Description of Artificial Sequence: Synthetic peptide
  Seed: KGQTGVMICAY (PTEN R130Q)
KQQTGVMICAY

SEQ ID NO: 17878 - protein, 11 aa, Artificial Sequence
  Description of Artificial Sequence: Synthetic peptide
  Seed: KGQTGVMICAY (PTEN R130Q)
KRQTGVMICAY

SEQ ID NO: 17879 - protein, 11 aa, Artificial Sequence
  Description of Artificial Sequence: Synthetic peptide
  Seed: KGQTGVMICAY (PTEN R130Q)
KSQTGVMICAY

SEQ ID NO: 17880 - protein, 11 aa, Artificial Sequence
  Description of Artificial Sequence: Synthetic peptide
  Seed: KGQTGVMICAY (PTEN R130Q)
KTQTGVMICAY

SEQ ID NO: 17881 - protein, 11 aa, Artificial Sequence
  Description of Artificial Sequence: Synthetic peptide
  Seed: KGQTGVMICAY (PTEN R130Q)
KVQTGVMICAY

SEQ ID NO: 17882 - protein, 11 aa, Artificial Sequence
  Description of Artificial Sequence: Synthetic peptide
  Seed: KGQTGVMICAY (PTEN R130Q)
KWQTGVMICAY

SEQ ID NO: 17883 - protein, 11 aa, Artificial Sequence
  Description of Artificial Sequence: Synthetic peptide
  Seed: KGQTGVMICAY (PTEN R130Q)
KYQTGVMICAY

SEQ ID NO: 17884 - protein, 9 aa, Artificial Sequence
  Description of Artificial Sequence: Synthetic peptide
  Seed: QTGVMICAY (PTEN R130Q)
QAGVMICAF

SEQ ID NO: 17885 - protein, 9 aa, Artificial Sequence
  Description of Artificial Sequence: Synthetic peptide
  Seed: QTGVMICAY (PTEN R130Q)
QAGVMICAW

SEQ ID NO: 17886 - protein, 9 aa, Artificial Sequence
  Description of Artificial Sequence: Synthetic peptide
  Seed: QTGVMICAY (PTEN R130Q)
QAGVMICAY

SEQ ID NO: 17887 - protein, 10 aa, Artificial Sequence
  Description of Artificial Sequence: Synthetic peptide
  Seed: QTGVMICAYL (PTEN R130Q)
QAGVMICAYA

SEQ ID NO: 17888 - protein, 10 aa, Artificial Sequence
  Description of Artificial Sequence: Synthetic peptide
  Seed: QTGVMICAYL (PTEN R130Q)
QAGVMICAYI

SEQ ID NO: 17889 - protein, 10 aa, Artificial Sequence
  Description of Artificial Sequence: Synthetic peptide
  Seed: QTGVMICAYL (PTEN R130Q)
QAGVMICAYL

SEQ ID NO: 17890 - protein, 10 aa, Artificial Sequence
  Description of Artificial Sequence: Synthetic peptide
  Seed: QTGVMICAYL (PTEN R130Q)
QAGVMICAYV

SEQ ID NO: 17891 - protein, 9 aa, Artificial Sequence
  Description of Artificial Sequence: Synthetic peptide
  Seed: QTGVMICAY (PTEN R130Q)
QFGVMICAY

SEQ ID NO: 17892 - protein, 9 aa, Artificial Sequence
  Description of Artificial Sequence: Synthetic peptide
  Seed: QTGVMICAY (PTEN R130Q)
QGGVMICAY

SEQ ID NO: 17893 - protein, 9 aa, Artificial Sequence
  Description of Artificial Sequence: Synthetic peptide
  Seed: QTGVMICAY (PTEN R130Q)
QIGVMICAF

SEQ ID NO: 17894 - protein, 9 aa, Artificial Sequence
  Description of Artificial Sequence: Synthetic peptide
  Seed: QTGVMICAY (PTEN R130Q)
QIGVMICAY

SEQ ID NO: 17895 - protein, 10 aa, Artificial Sequence
  Description of Artificial Sequence: Synthetic peptide
  Seed: QTGVMICAYL (PTEN R130Q)
QIGVMICAYV

SEQ ID NO: 17896 - protein, 9 aa, Artificial Sequence
  Description of Artificial Sequence: Synthetic peptide
  Seed: QTGVMICAY (PTEN R130Q)
QLGVMICAF

SEQ ID NO: 17897 - protein, 9 aa, Artificial Sequence
  Description of Artificial Sequence: Synthetic peptide
  Seed: QTGVMICAY (PTEN R130Q)
QLGVMICAM

SEQ ID NO: 17898 - protein, 9 aa, Artificial Sequence
  Description of Artificial Sequence: Synthetic peptide
  Seed: QTGVMICAY (PTEN R130Q)
QLGVMICAY

SEQ ID NO: 17899 - protein, 10 aa, Artificial Sequence
  Description of Artificial Sequence: Synthetic peptide
  Seed: QTGVMICAYL (PTEN R130Q)
QLGVMICAYL

SEQ ID NO: 17900 - protein, 10 aa, Artificial Sequence
  Description of Artificial Sequence: Synthetic peptide
  Seed: QTGVMICAYL (PTEN R130Q)
QLGVMICAYV

SEQ ID NO: 17901 - protein, 9 aa, Artificial Sequence
  Description of Artificial Sequence: Synthetic peptide
  Seed: QTGVMICAY (PTEN R130Q)
QMGVMICAF

SEQ ID NO: 17902 - protein, 9 aa, Artificial Sequence
  Description of Artificial Sequence: Synthetic peptide
  Seed: QTGVMICAY (PTEN R130Q)
QMGVMICAL

SEQ ID NO: 17903 - protein, 9 aa, Artificial Sequence
  Description of Artificial Sequence: Synthetic peptide
  Seed: QTGVMICAY (PTEN R130Q)
QMGVMICAM

SEQ ID NO: 17904 - protein, 10 aa, Artificial Sequence
  Description of Artificial Sequence: Synthetic peptide
  Seed: QTGVMICAYL (PTEN R130Q)
QMGVMICAYA

SEQ ID NO: 17905 - protein, 10 aa, Artificial Sequence
  Description of Artificial Sequence: Synthetic peptide
  Seed: QTGVMICAYL (PTEN R130Q)
QMGVMICAYL

SEQ ID NO: 17906 - protein, 10 aa, Artificial Sequence
  Description of Artificial Sequence: Synthetic peptide
  Seed: QTGVMICAYL (PTEN R130Q)
QMGVMICAYV

SEQ ID NO: 17907 - protein, 10 aa, Artificial Sequence
  Description of Artificial Sequence: Synthetic peptide
  Seed: QTGVMICAYL (PTEN R130Q)
QNGVMICAYV

SEQ ID NO: 17908 - protein, 9 aa, Artificial Sequence
  Description of Artificial Sequence: Synthetic peptide
  Seed: QTGVMICAY (PTEN R130Q)
QQGVMICAL

SEQ ID NO: 17909 - protein, 9 aa, Artificial Sequence
  Description of Artificial Sequence: Synthetic peptide
  Seed: QTGVMICAY (PTEN R130Q)
QQGVMICAM

SEQ ID NO: 17910 - protein, 10 aa, Artificial Sequence
  Description of Artificial Sequence: Synthetic peptide
  Seed: QTGVMICAYL (PTEN R130Q)
QQGVMICAYA

SEQ ID NO: 17911 - protein, 10 aa, Artificial Sequence
  Description of Artificial Sequence: Synthetic peptide
  Seed: QTGVMICAYL (PTEN R130Q)
QQGVMICAYI

SEQ ID NO: 17912 - protein, 10 aa, Artificial Sequence
  Description of Artificial Sequence: Synthetic peptide
  Seed: QTGVMICAYL (PTEN R130Q)
QQGVMICAYL

SEQ ID NO: 17913 - protein, 10 aa, Artificial Sequence
  Description of Artificial Sequence: Synthetic peptide
  Seed: QTGVMICAYL (PTEN R130Q)
QQGVMICAYV

SEQ ID NO: 17914 - protein, 9 aa, Artificial Sequence
  Description of Artificial Sequence: Synthetic peptide
  Seed: QTGVMICAY (PTEN R130Q)
QSGVMICAF

SEQ ID NO: 17915 - protein, 9 aa, Artificial Sequence
  Description of Artificial Sequence: Synthetic peptide
  Seed: QTGVMICAY (PTEN R130Q)
QSGVMICAW

SEQ ID NO: 17916 - protein, 9 aa, Artificial Sequence
  Description of Artificial Sequence: Synthetic peptide
  Seed: QTGVMICAY (PTEN R130Q)
QSGVMICAY

SEQ ID NO: 17917 - protein, 10 aa, Artificial Sequence
  Description of Artificial Sequence: Synthetic peptide
  Seed: QTGVMICAYL (PTEN R130Q)
QSGVMICAYA

SEQ ID NO: 17918 - protein, 10 aa, Artificial Sequence
  Description of Artificial Sequence: Synthetic peptide
  Seed: QTGVMICAYL (PTEN R130Q)
QSGVMICAYI

SEQ ID NO: 17919 - protein, 10 aa, Artificial Sequence
  Description of Artificial Sequence: Synthetic peptide
  Seed: QTGVMICAYL (PTEN R130Q)
QSGVMICAYL

SEQ ID NO: 17920 - protein, 9 aa, Artificial Sequence
  Description of Artificial Sequence: Synthetic peptide
  Seed: QTGVMICAY (PTEN R130Q)
QTGVMICAF

SEQ ID NO: 17921 - protein, 9 aa, Artificial Sequence
  Description of Artificial Sequence: Synthetic peptide
  Seed: QTGVMICAY (PTEN R130Q)
QTGVMICAW

SEQ ID NO: 17922 - protein, 10 aa, Artificial Sequence
  Description of Artificial Sequence: Synthetic peptide
  Seed: QTGVMICAYL (PTEN R130Q)
QTGVMICAYA

SEQ ID NO: 17923 - protein, 10 aa, Artificial Sequence
  Description of Artificial Sequence: Synthetic peptide
  Seed: QTGVMICAYL (PTEN R130Q)
QTGVMICAYM

SEQ ID NO: 17924 - protein, 10 aa, Artificial Sequence
  Description of Artificial Sequence: Synthetic peptide
  Seed: QTGVMICAYL (PTEN R130Q)
QTGVMICAYT

SEQ ID NO: 17925 - protein, 9 aa, Artificial Sequence
  Description of Artificial Sequence: Synthetic peptide
  Seed: QTGVMICAY (PTEN R130Q)
QVGVMICAF

SEQ ID NO: 17926 - protein, 9 aa, Artificial Sequence
  Description of Artificial Sequence: Synthetic peptide
  Seed: QTGVMICAY (PTEN R130Q)
QVGVMICAY

SEQ ID NO: 17927 - protein, 10 aa, Artificial Sequence
  Description of Artificial Sequence: Synthetic peptide
  Seed: QTGVMICAYL (PTEN R130Q)
QVGVMICAYA

SEQ ID NO: 17928 - protein, 10 aa, Artificial Sequence
  Description of Artificial Sequence: Synthetic peptide
  Seed: QTGVMICAYL (PTEN R130Q)
QVGVMICAYI

SEQ ID NO: 17929 - protein, 10 aa, Artificial Sequence
  Description of Artificial Sequence: Synthetic peptide
  Seed: QTGVMICAYL (PTEN R130Q)
QVGVMICAYL

SEQ ID NO: 17930 - protein, 10 aa, Artificial Sequence
  Description of Artificial Sequence: Synthetic peptide
  Seed: QTGVMICAYL (PTEN R130Q)
QVGVMICAYV

SEQ ID NO: 17931 - protein, 9 aa, Artificial Sequence
  Description of Artificial Sequence: Synthetic peptide
  Seed: QTGVMICAY (PTEN R130Q)
QWGVMICAY

SEQ ID NO: 17932 - protein, 9 aa, Artificial Sequence
  Description of Artificial Sequence: Synthetic peptide
  Seed: QTGVMICAY (PTEN R130Q)
QYGVMICAY

SEQ ID NO: 17933 - protein, 9 aa, Artificial Sequence
  Description of Artificial Sequence: Synthetic peptide
  Seed: AGKGQTGVM (PTEN R130Q)
AAKGQTGVA

SEQ ID NO: 17934 - protein, 9 aa, Artificial Sequence
  Description of Artificial Sequence: Synthetic peptide
  Seed: AGKGQTGVM (PTEN R130Q)
AAKGQTGVC

SEQ ID NO: 17935 - protein, 9 aa, Artificial Sequence
  Description of Artificial Sequence: Synthetic peptide
  Seed: AGKGQTGVM (PTEN R130Q)
AAKGQTGVG

SEQ ID NO: 17936 - protein, 9 aa, Artificial Sequence
  Description of Artificial Sequence: Synthetic peptide
  Seed: AGKGQTGVM (PTEN R130Q)
AAKGQTGVH

SEQ ID NO: 17937 - protein, 9 aa, Artificial Sequence
  Description of Artificial Sequence: Synthetic peptide
  Seed: AGKGQTGVM (PTEN R130Q)
AAKGQTGVI

SEQ ID NO: 17938 - protein, 9 aa, Artificial Sequence
  Description of Artificial Sequence: Synthetic peptide
  Seed: AGKGQTGVM (PTEN R130Q)
AAKGQTGVK

SEQ ID NO: 17939 - protein, 9 aa, Artificial Sequence
  Description of Artificial Sequence: Synthetic peptide
  Seed: AGKGQTGVM (PTEN R130Q)
AAKGQTGVM

SEQ ID NO: 17940 - protein, 9 aa, Artificial Sequence
  Description of Artificial Sequence: Synthetic peptide
  Seed: AGKGQTGVM (PTEN R130Q)
AAKGQTGVP

SEQ ID NO: 17941 - protein, 9 aa, Artificial Sequence
  Description of Artificial Sequence: Synthetic peptide
  Seed: AGKGQTGVM (PTEN R130Q)
AAKGQTGVQ

SEQ ID NO: 17942 - protein, 9 aa, Artificial Sequence
  Description of Artificial Sequence: Synthetic peptide
  Seed: AGKGQTGVM (PTEN R130Q)
AAKGQTGVR

SEQ ID NO: 17943 - protein, 9 aa, Artificial Sequence
  Description of Artificial Sequence: Synthetic peptide
  Seed: AGKGQTGVM (PTEN R130Q)
AAKGQTGVS

SEQ ID NO: 17944 - protein, 9 aa, Artificial Sequence
  Description of Artificial Sequence: Synthetic peptide
  Seed: AGKGQTGVM (PTEN R130Q)
AAKGQTGVT

SEQ ID NO: 17945 - protein, 9 aa, Artificial Sequence
  Description of Artificial Sequence: Synthetic peptide
  Seed: AGKGQTGVM (PTEN R130Q)
AAKGQTGVV

SEQ ID NO: 17946 - protein, 9 aa, Artificial Sequence
  Description of Artificial Sequence: Synthetic peptide
  Seed: AGKGQTGVM (PTEN R130Q)
AAKGQTGVW

SEQ ID NO: 17947 - protein, 9 aa, Artificial Sequence
  Description of Artificial Sequence: Synthetic peptide
  Seed: AGKGQTGVM (PTEN R130Q)
ACKGQTGVF

SEQ ID NO: 17948 - protein, 9 aa, Artificial Sequence
  Description of Artificial Sequence: Synthetic peptide
  Seed: AGKGQTGVM (PTEN R130Q)
ACKGQTGVL

SEQ ID NO: 17949 - protein, 9 aa, Artificial Sequence
  Description of Artificial Sequence: Synthetic peptide
  Seed: AGKGQTGVM (PTEN R130Q)
ACKGQTGVM

SEQ ID NO: 17950 - protein, 9 aa, Artificial Sequence
  Description of Artificial Sequence: Synthetic peptide
  Seed: AGKGQTGVM (PTEN R130Q)
ACKGQTGVY

SEQ ID NO: 17951 - protein, 9 aa, Artificial Sequence
  Description of Artificial Sequence: Synthetic peptide
  Seed: AGKGQTGVM (PTEN R130Q)
ADKGQTGVF

SEQ ID NO: 17952 - protein, 9 aa, Artificial Sequence
  Description of Artificial Sequence: Synthetic peptide
  Seed: AGKGQTGVM (PTEN R130Q)
ADKGQTGVK

SEQ ID NO: 17953 - protein, 9 aa, Artificial Sequence
  Description of Artificial Sequence: Synthetic peptide
  Seed: AGKGQTGVM (PTEN R130Q)
ADKGQTGVL

SEQ ID NO: 17954 - protein, 9 aa, Artificial Sequence
  Description of Artificial Sequence: Synthetic peptide
  Seed: AGKGQTGVM (PTEN R130Q)
ADKGQTGVY

SEQ ID NO: 17955 - protein, 9 aa, Artificial Sequence
  Description of Artificial Sequence: Synthetic peptide
  Seed: AGKGQTGVM (PTEN R130Q)
AEKGQTGVF

SEQ ID NO: 17956 - protein, 9 aa, Artificial Sequence
  Description of Artificial Sequence: Synthetic peptide
  Seed: AGKGQTGVM (PTEN R130Q)
AEKGQTGVI

SEQ ID NO: 17957 - protein, 9 aa, Artificial Sequence
  Description of Artificial Sequence: Synthetic peptide
  Seed: AGKGQTGVM (PTEN R130Q)
AEKGQTGVL

SEQ ID NO: 17958 - protein, 9 aa, Artificial Sequence
  Description of Artificial Sequence: Synthetic peptide
  Seed: AGKGQTGVM (PTEN R130Q)
AEKGQTGVM

SEQ ID NO: 17959 - protein, 9 aa, Artificial Sequence
  Description of Artificial Sequence: Synthetic peptide
  Seed: AGKGQTGVM (PTEN R130Q)
AEKGQTGVW

SEQ ID NO: 17960 - protein, 9 aa, Artificial Sequence
  Description of Artificial Sequence: Synthetic peptide
  Seed: AGKGQTGVM (PTEN R130Q)
AEKGQTGVY

SEQ ID NO: 17961 - protein, 9 aa, Artificial Sequence
  Description of Artificial Sequence: Synthetic peptide
  Seed: AGKGQTGVM (PTEN R130Q)
AFKGQTGVF

SEQ ID NO: 17962 - protein, 9 aa, Artificial Sequence
  Description of Artificial Sequence: Synthetic peptide
  Seed: AGKGQTGVM (PTEN R130Q)
AFKGQTGVL

SEQ ID NO: 17963 - protein, 9 aa, Artificial Sequence
  Description of Artificial Sequence: Synthetic peptide
  Seed: AGKGQTGVM (PTEN R130Q)
AFKGQTGVM

SEQ ID NO: 17964 - protein, 9 aa, Artificial Sequence
  Description of Artificial Sequence: Synthetic peptide
  Seed: AGKGQTGVM (PTEN R130Q)
AFKGQTGVY

SEQ ID NO: 17965 - protein, 9 aa, Artificial Sequence
  Description of Artificial Sequence: Synthetic peptide
  Seed: AGKGQTGVM (PTEN R130Q)
AGKGQTGVF

SEQ ID NO: 17966 - protein, 9 aa, Artificial Sequence
  Description of Artificial Sequence: Synthetic peptide
  Seed: AGKGQTGVM (PTEN R130Q)
AGKGQTGVH

SEQ ID NO: 17967 - protein, 9 aa, Artificial Sequence
  Description of Artificial Sequence: Synthetic peptide
  Seed: AGKGQTGVM (PTEN R130Q)
AGKGQTGVI

SEQ ID NO: 17968 - protein, 9 aa, Artificial Sequence
  Description of Artificial Sequence: Synthetic peptide
  Seed: AGKGQTGVM (PTEN R130Q)
AGKGQTGVK

SEQ ID NO: 17969 - protein, 9 aa, Artificial Sequence
  Description of Artificial Sequence: Synthetic peptide
  Seed: AGKGQTGVM (PTEN R130Q)
AGKGQTGVL

SEQ ID NO: 17970 - protein, 9 aa, Artificial Sequence
  Description of Artificial Sequence: Synthetic peptide
  Seed: AGKGQTGVM (PTEN R130Q)
AGKGQTGVV

SEQ ID NO: 17971 - protein, 9 aa, Artificial Sequence
  Description of Artificial Sequence: Synthetic peptide
  Seed: AGKGQTGVM (PTEN R130Q)
AGKGQTGVY

SEQ ID NO: 17972 - protein, 9 aa, Artificial Sequence
  Description of Artificial Sequence: Synthetic peptide
  Seed: AGKGQTGVM (PTEN R130Q)
AHKGQTGVF

SEQ ID NO: 17973 - protein, 9 aa, Artificial Sequence
  Description of Artificial Sequence: Synthetic peptide
  Seed: AGKGQTGVM (PTEN R130Q)
AHKGQTGVL

SEQ ID NO: 17974 - protein, 9 aa, Artificial Sequence
  Description of Artificial Sequence: Synthetic peptide
  Seed: AGKGQTGVM (PTEN R130Q)
AHKGQTGVM

SEQ ID NO: 17975 - protein, 9 aa, Artificial Sequence
  Description of Artificial Sequence: Synthetic peptide
  Seed: AGKGQTGVM (PTEN R130Q)
AHKGQTGVY

SEQ ID NO: 17976 - protein, 9 aa, Artificial Sequence
  Description of Artificial Sequence: Synthetic peptide
  Seed: AGKGQTGVM (PTEN R130Q)
AIKGQTGVA

SEQ ID NO: 17977 - protein, 9 aa, Artificial Sequence
  Description of Artificial Sequence: Synthetic peptide
  Seed: AGKGQTGVM (PTEN R130Q)
AIKGQTGVF

SEQ ID NO: 17978 - protein, 9 aa, Artificial Sequence
  Description of Artificial Sequence: Synthetic peptide
  Seed: AGKGQTGVM (PTEN R130Q)
AIKGQTGVH

SEQ ID NO: 17979 - protein, 9 aa, Artificial Sequence
  Description of Artificial Sequence: Synthetic peptide
  Seed: AGKGQTGVM (PTEN R130Q)
AIKGQTGVI

SEQ ID NO: 17980 - protein, 9 aa, Artificial Sequence
  Description of Artificial Sequence: Synthetic peptide
  Seed: AGKGQTGVM (PTEN R130Q)
AIKGQTGVK

SEQ ID NO: 17981 - protein, 9 aa, Artificial Sequence
  Description of Artificial Sequence: Synthetic peptide
  Seed: AGKGQTGVM (PTEN R130Q)
AIKGQTGVL

SEQ ID NO: 17982 - protein, 9 aa, Artificial Sequence
  Description of Artificial Sequence: Synthetic peptide
  Seed: AGKGQTGVM (PTEN R130Q)
AIKGQTGVM

SEQ ID NO: 17983 - protein, 9 aa, Artificial Sequence
  Description of Artificial Sequence: Synthetic peptide
  Seed: AGKGQTGVM (PTEN R130Q)
AIKGQTGVR

SEQ ID NO: 17984 - protein, 9 aa, Artificial Sequence
  Description of Artificial Sequence: Synthetic peptide
  Seed: AGKGQTGVM (PTEN R130Q)
AIKGQTGVV

SEQ ID NO: 17985 - protein, 9 aa, Artificial Sequence
  Description of Artificial Sequence: Synthetic peptide
  Seed: AGKGQTGVM (PTEN R130Q)
AIKGQTGVW

SEQ ID NO: 17986 - protein, 9 aa, Artificial Sequence
  Description of Artificial Sequence: Synthetic peptide
  Seed: AGKGQTGVM (PTEN R130Q)
AIKGQTGVY

SEQ ID NO: 17987 - protein, 9 aa, Artificial Sequence
  Description of Artificial Sequence: Synthetic peptide
  Seed: AGKGQTGVM (PTEN R130Q)
AKKGQTGVF

SEQ ID NO: 17988 - protein, 9 aa, Artificial Sequence
  Description of Artificial Sequence: Synthetic peptide
  Seed: AGKGQTGVM (PTEN R130Q)
AKKGQTGVY

SEQ ID NO: 17989 - protein, 9 aa, Artificial Sequence
  Description of Artificial Sequence: Synthetic peptide
  Seed: AGKGQTGVM (PTEN R130Q)
ALKGQTGVF

SEQ ID NO: 17990 - protein, 9 aa, Artificial Sequence
  Description of Artificial Sequence: Synthetic peptide
  Seed: AGKGQTGVM (PTEN R130Q)
ALKGQTGVH

SEQ ID NO: 17991 - protein, 9 aa, Artificial Sequence
  Description of Artificial Sequence: Synthetic peptide
  Seed: AGKGQTGVM (PTEN R130Q)
ALKGQTGVI

SEQ ID NO: 17992 - protein, 9 aa, Artificial Sequence
  Description of Artificial Sequence: Synthetic peptide
  Seed: AGKGQTGVM (PTEN R130Q)
ALKGQTGVL

SEQ ID NO: 17993 - protein, 9 aa, Artificial Sequence
  Description of Artificial Sequence: Synthetic peptide
  Seed: AGKGQTGVM (PTEN R130Q)
ALKGQTGVM

SEQ ID NO: 17994 - protein, 9 aa, Artificial Sequence
  Description of Artificial Sequence: Synthetic peptide
  Seed: AGKGQTGVM (PTEN R130Q)
ALKGQTGVV

SEQ ID NO: 17995 - protein, 9 aa, Artificial Sequence
  Description of Artificial Sequence: Synthetic peptide
  Seed: AGKGQTGVM (PTEN R130Q)
ALKGQTGVW

SEQ ID NO: 17996 - protein, 9 aa, Artificial Sequence
  Description of Artificial Sequence: Synthetic peptide
  Seed: AGKGQTGVM (PTEN R130Q)
ALKGQTGVY

SEQ ID NO: 17997 - protein, 9 aa, Artificial Sequence
  Description of Artificial Sequence: Synthetic peptide
  Seed: AGKGQTGVM (PTEN R130Q)
AMKGQTGVF

SEQ ID NO: 17998 - protein, 9 aa, Artificial Sequence
  Description of Artificial Sequence: Synthetic peptide
  Seed: AGKGQTGVM (PTEN R130Q)
AMKGQTGVH

SEQ ID NO: 17999 - protein, 9 aa, Artificial Sequence
  Description of Artificial Sequence: Synthetic peptide
  Seed: AGKGQTGVM (PTEN R130Q)
AMKGQTGVI

SEQ ID NO: 18000 - protein, 9 aa, Artificial Sequence
  Description of Artificial Sequence: Synthetic peptide
  Seed: AGKGQTGVM (PTEN R130Q)
AMKGQTGVL

SEQ ID NO: 18001 - protein, 9 aa, Artificial Sequence
  Description of Artificial Sequence: Synthetic peptide
  Seed: AGKGQTGVM (PTEN R130Q)
AMKGQTGVM

SEQ ID NO: 18002 - protein, 9 aa, Artificial Sequence
  Description of Artificial Sequence: Synthetic peptide
  Seed: AGKGQTGVM (PTEN R130Q)
AMKGQTGVV

SEQ ID NO: 18003 - protein, 9 aa, Artificial Sequence
  Description of Artificial Sequence: Synthetic peptide
  Seed: AGKGQTGVM (PTEN R130Q)
AMKGQTGVW

SEQ ID NO: 18004 - protein, 9 aa, Artificial Sequence
  Description of Artificial Sequence: Synthetic peptide
  Seed: AGKGQTGVM (PTEN R130Q)
AMKGQTGVY

SEQ ID NO: 18005 - protein, 9 aa, Artificial Sequence
  Description of Artificial Sequence: Synthetic peptide
  Seed: AGKGQTGVM (PTEN R130Q)
ANKGQTGVF

SEQ ID NO: 18006 - protein, 9 aa, Artificial Sequence
  Description of Artificial Sequence: Synthetic peptide
  Seed: AGKGQTGVM (PTEN R130Q)
ANKGQTGVH

SEQ ID NO: 18007 - protein, 9 aa, Artificial Sequence
  Description of Artificial Sequence: Synthetic peptide
  Seed: AGKGQTGVM (PTEN R130Q)
ANKGQTGVL

SEQ ID NO: 18008 - protein, 9 aa, Artificial Sequence
  Description of Artificial Sequence: Synthetic peptide
  Seed: AGKGQTGVM (PTEN R130Q)
ANKGQTGVM

SEQ ID NO: 18009 - protein, 9 aa, Artificial Sequence
  Description of Artificial Sequence: Synthetic peptide
  Seed: AGKGQTGVM (PTEN R130Q)
ANKGQTGVY

SEQ ID NO: 18010 - protein, 9 aa, Artificial Sequence
  Description of Artificial Sequence: Synthetic peptide
  Seed: AGKGQTGVM (PTEN R130Q)
APKGQTGVF

SEQ ID NO: 18011 - protein, 9 aa, Artificial Sequence
  Description of Artificial Sequence: Synthetic peptide
  Seed: AGKGQTGVM (PTEN R130Q)
APKGQTGVL

SEQ ID NO: 18012 - protein, 9 aa, Artificial Sequence
  Description of Artificial Sequence: Synthetic peptide
  Seed: AGKGQTGVM (PTEN R130Q)
APKGQTGVM

SEQ ID NO: 18013 - protein, 9 aa, Artificial Sequence
  Description of Artificial Sequence: Synthetic peptide
  Seed: AGKGQTGVM (PTEN R130Q)
APKGQTGVY

SEQ ID NO: 18014 - protein, 9 aa, Artificial Sequence
  Description of Artificial Sequence: Synthetic peptide
  Seed: AGKGQTGVM (PTEN R130Q)
AQKGQTGVA

SEQ ID NO: 18015 - protein, 9 aa, Artificial Sequence
  Description of Artificial Sequence: Synthetic peptide
  Seed: AGKGQTGVM (PTEN R130Q)
AQKGQTGVF

SEQ ID NO: 18016 - protein, 9 aa, Artificial Sequence
  Description of Artificial Sequence: Synthetic peptide
  Seed: AGKGQTGVM (PTEN R130Q)
AQKGQTGVH

SEQ ID NO: 18017 - protein, 9 aa, Artificial Sequence
  Description of Artificial Sequence: Synthetic peptide
  Seed: AGKGQTGVM (PTEN R130Q)
AQKGQTGVI

SEQ ID NO: 18018 - protein, 9 aa, Artificial Sequence
  Description of Artificial Sequence: Synthetic peptide
  Seed: AGKGQTGVM (PTEN R130Q)
AQKGQTGVL

SEQ ID NO: 18019 - protein, 9 aa, Artificial Sequence
  Description of Artificial Sequence: Synthetic peptide
  Seed: AGKGQTGVM (PTEN R130Q)
AQKGQTGVM

SEQ ID NO: 18020 - protein, 9 aa, Artificial Sequence
  Description of Artificial Sequence: Synthetic peptide
  Seed: AGKGQTGVM (PTEN R130Q)
AQKGQTGVV

SEQ ID NO: 18021 - protein, 9 aa, Artificial Sequence
  Description of Artificial Sequence: Synthetic peptide
  Seed: AGKGQTGVM (PTEN R130Q)
AQKGQTGVW

SEQ ID NO: 18022 - protein, 9 aa, Artificial Sequence
  Description of Artificial Sequence: Synthetic peptide
  Seed: AGKGQTGVM (PTEN R130Q)
ARKGQTGVF

SEQ ID NO: 18023 - protein, 9 aa, Artificial Sequence
  Description of Artificial Sequence: Synthetic peptide
  Seed: AGKGQTGVM (PTEN R130Q)
ARKGQTGVI

SEQ ID NO: 18024 - protein, 9 aa, Artificial Sequence
  Description of Artificial Sequence: Synthetic peptide
  Seed: AGKGQTGVM (PTEN R130Q)
ARKGQTGVL

SEQ ID NO: 18025 - protein, 9 aa, Artificial Sequence
  Description of Artificial Sequence: Synthetic peptide
  Seed: AGKGQTGVM (PTEN R130Q)
ARKGQTGVM

SEQ ID NO: 18026 - protein, 9 aa, Artificial Sequence
  Description of Artificial Sequence: Synthetic peptide
  Seed: AGKGQTGVM (PTEN R130Q)
ARKGQTGVV

SEQ ID NO: 18027 - protein, 9 aa, Artificial Sequence
  Description of Artificial Sequence: Synthetic peptide
  Seed: AGKGQTGVM (PTEN R130Q)
ARKGQTGVY

SEQ ID NO: 18028 - protein, 9 aa, Artificial Sequence
  Description of Artificial Sequence: Synthetic peptide
  Seed: AGKGQTGVM (PTEN R130Q)
ASKGQTGVA

SEQ ID NO: 18029 - protein, 9 aa, Artificial Sequence
  Description of Artificial Sequence: Synthetic peptide
  Seed: AGKGQTGVM (PTEN R130Q)
ASKGQTGVC

SEQ ID NO: 18030 - protein, 9 aa, Artificial Sequence
  Description of Artificial Sequence: Synthetic peptide
  Seed: AGKGQTGVM (PTEN R130Q)
ASKGQTGVF

SEQ ID NO: 18031 - protein, 9 aa, Artificial Sequence
  Description of Artificial Sequence: Synthetic peptide
  Seed: AGKGQTGVM (PTEN R130Q)
ASKGQTGVH

SEQ ID NO: 18032 - protein, 9 aa, Artificial Sequence
  Description of Artificial Sequence: Synthetic peptide
  Seed: AGKGQTGVM (PTEN R130Q)
ASKGQTGVI

SEQ ID NO: 18033 - protein, 9 aa, Artificial Sequence
  Description of Artificial Sequence: Synthetic peptide
  Seed: AGKGQTGVM (PTEN R130Q)
ASKGQTGVK

SEQ ID NO: 18034 - protein, 9 aa, Artificial Sequence
  Description of Artificial Sequence: Synthetic peptide
  Seed: AGKGQTGVM (PTEN R130Q)
ASKGQTGVL

SEQ ID NO: 18035 - protein, 9 aa, Artificial Sequence
  Description of Artificial Sequence: Synthetic peptide
  Seed: AGKGQTGVM (PTEN R130Q)
ASKGQTGVM

SEQ ID NO: 18036 - protein, 9 aa, Artificial Sequence
  Description of Artificial Sequence: Synthetic peptide
  Seed: AGKGQTGVM (PTEN R130Q)
ASKGQTGVR

SEQ ID NO: 18037 - protein, 9 aa, Artificial Sequence
  Description of Artificial Sequence: Synthetic peptide
  Seed: AGKGQTGVM (PTEN R130Q)
ASKGQTGVV

SEQ ID NO: 18038 - protein, 9 aa, Artificial Sequence
  Description of Artificial Sequence: Synthetic peptide
  Seed: AGKGQTGVM (PTEN R130Q)
ASKGQTGVW

SEQ ID NO: 18039 - protein, 9 aa, Artificial Sequence
  Description of Artificial Sequence: Synthetic peptide
  Seed: AGKGQTGVM (PTEN R130Q)
ASKGQTGVY

SEQ ID NO: 18040 - protein, 9 aa, Artificial Sequence
  Description of Artificial Sequence: Synthetic peptide
  Seed: AGKGQTGVM (PTEN R130Q)
ATKGQTGVA

SEQ ID NO: 18041 - protein, 9 aa, Artificial Sequence
  Description of Artificial Sequence: Synthetic peptide
  Seed: AGKGQTGVM (PTEN R130Q)
ATKGQTGVF

SEQ ID NO: 18042 - protein, 9 aa, Artificial Sequence
  Description of Artificial Sequence: Synthetic peptide
  Seed: AGKGQTGVM (PTEN R130Q)
ATKGQTGVH

SEQ ID NO: 18043 - protein, 9 aa, Artificial Sequence
  Description of Artificial Sequence: Synthetic peptide
  Seed: AGKGQTGVM (PTEN R130Q)
ATKGQTGVI

SEQ ID NO: 18044 - protein, 9 aa, Artificial Sequence
  Description of Artificial Sequence: Synthetic peptide
  Seed: AGKGQTGVM (PTEN R130Q)
ATKGQTGVL

SEQ ID NO: 18045 - protein, 9 aa, Artificial Sequence
  Description of Artificial Sequence: Synthetic peptide
  Seed: AGKGQTGVM (PTEN R130Q)
ATKGQTGVM

SEQ ID NO: 18046 - protein, 9 aa, Artificial Sequence
  Description of Artificial Sequence: Synthetic peptide
  Seed: AGKGQTGVM (PTEN R130Q)
ATKGQTGVV

SEQ ID NO: 18047 - protein, 9 aa, Artificial Sequence
  Description of Artificial Sequence: Synthetic peptide
  Seed: AGKGQTGVM (PTEN R130Q)
ATKGQTGVW

SEQ ID NO: 18048 - protein, 9 aa, Artificial Sequence
  Description of Artificial Sequence: Synthetic peptide
  Seed: AGKGQTGVM (PTEN R130Q)
ATKGQTGVY

SEQ ID NO: 18049 - protein, 9 aa, Artificial Sequence
  Description of Artificial Sequence: Synthetic peptide
  Seed: AGKGQTGVM (PTEN R130Q)
AVKGQTGVA

SEQ ID NO: 18050 - protein, 9 aa, Artificial Sequence
  Description of Artificial Sequence: Synthetic peptide
  Seed: AGKGQTGVM (PTEN R130Q)
AVKGQTGVC

SEQ ID NO: 18051 - protein, 9 aa, Artificial Sequence
  Description of Artificial Sequence: Synthetic peptide
  Seed: AGKGQTGVM (PTEN R130Q)
AVKGQTGVF

SEQ ID NO: 18052 - protein, 9 aa, Artificial Sequence
  Description of Artificial Sequence: Synthetic peptide
  Seed: AGKGQTGVM (PTEN R130Q)
AVKGQTGVH

SEQ ID NO: 18053 - protein, 9 aa, Artificial Sequence
  Description of Artificial Sequence: Synthetic peptide
  Seed: AGKGQTGVM (PTEN R130Q)
AVKGQTGVI

SEQ ID NO: 18054 - protein, 9 aa, Artificial Sequence
  Description of Artificial Sequence: Synthetic peptide
  Seed: AGKGQTGVM (PTEN R130Q)
AVKGQTGVK

SEQ ID NO: 18055 - protein, 9 aa, Artificial Sequence
  Description of Artificial Sequence: Synthetic peptide
  Seed: AGKGQTGVM (PTEN R130Q)
AVKGQTGVL

SEQ ID NO: 18056 - protein, 9 aa, Artificial Sequence
  Description of Artificial Sequence: Synthetic peptide
  Seed: AGKGQTGVM (PTEN R130Q)
AVKGQTGVM

SEQ ID NO: 18057 - protein, 9 aa, Artificial Sequence
  Description of Artificial Sequence: Synthetic peptide
  Seed: AGKGQTGVM (PTEN R130Q)
AVKGQTGVV

SEQ ID NO: 18058 - protein, 9 aa, Artificial Sequence
  Description of Artificial Sequence: Synthetic peptide
  Seed: AGKGQTGVM (PTEN R130Q)
AVKGQTGVW

SEQ ID NO: 18059 - protein, 9 aa, Artificial Sequence
  Description of Artificial Sequence: Synthetic peptide
  Seed: AGKGQTGVM (PTEN R130Q)
AVKGQTGVY

SEQ ID NO: 18060 - protein, 9 aa, Artificial Sequence
  Description of Artificial Sequence: Synthetic peptide
  Seed: AGKGQTGVM (PTEN R130Q)
AWKGQTGVF

SEQ ID NO: 18061 - protein, 9 aa, Artificial Sequence
  Description of Artificial Sequence: Synthetic peptide
  Seed: AGKGQTGVM (PTEN R130Q)
AWKGQTGVY

SEQ ID NO: 18062 - protein, 9 aa, Artificial Sequence
  Description of Artificial Sequence: Synthetic peptide
  Seed: AGKGQTGVM (PTEN R130Q)
AYKGQTGVF

SEQ ID NO: 18063 - protein, 9 aa, Artificial Sequence
  Description of Artificial Sequence: Synthetic peptide
  Seed: AGKGQTGVM (PTEN R130Q)
AYKGQTGVI

SEQ ID NO: 18064 - protein, 9 aa, Artificial Sequence
  Description of Artificial Sequence: Synthetic peptide
  Seed: AGKGQTGVM (PTEN R130Q)
AYKGQTGVL

SEQ ID NO: 18065 - protein, 9 aa, Artificial Sequence
  Description of Artificial Sequence: Synthetic peptide
  Seed: AGKGQTGVM (PTEN R130Q)
AYKGQTGVM

SEQ ID NO: 18066 - protein, 9 aa, Artificial Sequence
  Description of Artificial Sequence: Synthetic peptide
  Seed: AGKGQTGVM (PTEN R130Q)
AYKGQTGVY

SEQ ID NO: 18067 - protein, 9 aa, Artificial Sequence
  Description of Artificial Sequence: Synthetic peptide
  Seed: KAGKGQTGV (PTEN R130Q)
KAGKGQTGF

SEQ ID NO: 18068 - protein, 9 aa, Artificial Sequence
  Description of Artificial Sequence: Synthetic peptide
  Seed: KAGKGQTGV (PTEN R130Q)
KAGKGQTGH

SEQ ID NO: 18069 - protein, 9 aa, Artificial Sequence
  Description of Artificial Sequence: Synthetic peptide
  Seed: KAGKGQTGV (PTEN R130Q)
KAGKGQTGI

SEQ ID NO: 18070 - protein, 9 aa, Artificial Sequence
  Description of Artificial Sequence: Synthetic peptide
  Seed: KAGKGQTGV (PTEN R130Q)
KAGKGQTGL

SEQ ID NO: 18071 - protein, 9 aa, Artificial Sequence
  Description of Artificial Sequence: Synthetic peptide
  Seed: KAGKGQTGV (PTEN R130Q)
KAGKGQTGM

SEQ ID NO: 18072 - protein, 10 aa, Artificial Sequence
  Description of Artificial Sequence: Synthetic peptide
  Seed: KAGKGQTGVM (PTEN R130Q)
KAGKGQTGVF

SEQ ID NO: 18073 - protein, 10 aa, Artificial Sequence
  Description of Artificial Sequence: Synthetic peptide
  Seed: KAGKGQTGVM (PTEN R130Q)
KAGKGQTGVH

SEQ ID NO: 18074 - protein, 10 aa, Artificial Sequence
  Description of Artificial Sequence: Synthetic peptide
  Seed: KAGKGQTGVM (PTEN R130Q)
KAGKGQTGVL

SEQ ID NO: 18075 - protein, 11 aa, Artificial Sequence
  Description of Artificial Sequence: Synthetic peptide
  Seed: KAGKGQTGVMI (PTEN R130Q)
KAGKGQTGVML

SEQ ID NO: 18076 - protein, 11 aa, Artificial Sequence
  Description of Artificial Sequence: Synthetic peptide
  Seed: KAGKGQTGVMI (PTEN R130Q)
KAGKGQTGVMM

SEQ ID NO: 18077 - protein, 10 aa, Artificial Sequence
  Description of Artificial Sequence: Synthetic peptide
  Seed: KAGKGQTGVM (PTEN R130Q)
KAGKGQTGVY

SEQ ID NO: 18078 - protein, 9 aa, Artificial Sequence
  Description of Artificial Sequence: Synthetic peptide
  Seed: KAGKGQTGV (PTEN R130Q)
KAGKGQTGY

SEQ ID NO: 18079 - protein, 9 aa, Artificial Sequence
  Description of Artificial Sequence: Synthetic peptide
  Seed: KAGKGQTGV (PTEN R130Q)
KEGKGQTGI

SEQ ID NO: 18080 - protein, 9 aa, Artificial Sequence
  Description of Artificial Sequence: Synthetic peptide
  Seed: KAGKGQTGV (PTEN R130Q)
KEGKGQTGV

SEQ ID NO: 18081 - protein, 10 aa, Artificial Sequence
  Description of Artificial Sequence: Synthetic peptide
  Seed: KAGKGQTGVM (PTEN R130Q)
KEGKGQTGVY

SEQ ID NO: 18082 - protein, 10 aa, Artificial Sequence
  Description of Artificial Sequence: Synthetic peptide
  Seed: KAGKGQTGVM (PTEN R130Q)
KGGKGQTGVY

SEQ ID NO: 18083 - protein, 9 aa, Artificial Sequence
  Description of Artificial Sequence: Synthetic peptide
  Seed: KAGKGQTGV (PTEN R130Q)
KGGKGQTGY

SEQ ID NO: 18084 - protein, 9 aa, Artificial Sequence
  Description of Artificial Sequence: Synthetic peptide
  Seed: KAGKGQTGV (PTEN R130Q)
KIGKGQTGF

SEQ ID NO: 18085 - protein, 9 aa, Artificial Sequence
  Description of Artificial Sequence: Synthetic peptide
  Seed: KAGKGQTGV (PTEN R130Q)
KIGKGQTGI

SEQ ID NO: 18086 - protein, 9 aa, Artificial Sequence
  Description of Artificial Sequence: Synthetic peptide
  Seed: KAGKGQTGV (PTEN R130Q)
KIGKGQTGL

SEQ ID NO: 18087 - protein, 9 aa, Artificial Sequence
  Description of Artificial Sequence: Synthetic peptide
  Seed: KAGKGQTGV (PTEN R130Q)
KIGKGQTGM

SEQ ID NO: 18088 - protein, 9 aa, Artificial Sequence
  Description of Artificial Sequence: Synthetic peptide
  Seed: KAGKGQTGV (PTEN R130Q)
KIGKGQTGV

SEQ ID NO: 18089 - protein, 10 aa, Artificial Sequence
  Description of Artificial Sequence: Synthetic peptide
  Seed: KAGKGQTGVM (PTEN R130Q)
KIGKGQTGVF

SEQ ID NO: 18090 - protein, 10 aa, Artificial Sequence
  Description of Artificial Sequence: Synthetic peptide
  Seed: KAGKGQTGVM (PTEN R130Q)
KIGKGQTGVY

SEQ ID NO: 18091 - protein, 9 aa, Artificial Sequence
  Description of Artificial Sequence: Synthetic peptide
  Seed: KAGKGQTGV (PTEN R130Q)
KIGKGQTGY

SEQ ID NO: 18092 - protein, 9 aa, Artificial Sequence
  Description of Artificial Sequence: Synthetic peptide
  Seed: KAGKGQTGV (PTEN R130Q)
KLGKGQTGA

SEQ ID NO: 18093 - protein, 9 aa, Artificial Sequence
  Description of Artificial Sequence: Synthetic peptide
  Seed: KAGKGQTGV (PTEN R130Q)
KLGKGQTGI

SEQ ID NO: 18094 - protein, 9 aa, Artificial Sequence
  Description of Artificial Sequence: Synthetic peptide
  Seed: KAGKGQTGV (PTEN R130Q)
KLGKGQTGL

SEQ ID NO: 18095 - protein, 9 aa, Artificial Sequence
  Description of Artificial Sequence: Synthetic peptide
  Seed: KAGKGQTGV (PTEN R130Q)
KLGKGQTGV

SEQ ID NO: 18096 - protein, 10 aa, Artificial Sequence
  Description of Artificial Sequence: Synthetic peptide
  Seed: KAGKGQTGVM (PTEN R130Q)
KLGKGQTGVY

SEQ ID NO: 18097 - protein, 9 aa, Artificial Sequence
  Description of Artificial Sequence: Synthetic peptide
  Seed: KAGKGQTGV (PTEN R130Q)
KLGKGQTGY

SEQ ID NO: 18098 - protein, 9 aa, Artificial Sequence
  Description of Artificial Sequence: Synthetic peptide
  Seed: KAGKGQTGV (PTEN R130Q)
KMGKGQTGA

SEQ ID NO: 18099 - protein, 9 aa, Artificial Sequence
  Description of Artificial Sequence: Synthetic peptide
  Seed: KAGKGQTGV (PTEN R130Q)
KMGKGQTGI

SEQ ID NO: 18100 - protein, 9 aa, Artificial Sequence
  Description of Artificial Sequence: Synthetic peptide
  Seed: KAGKGQTGV (PTEN R130Q)
KMGKGQTGL

SEQ ID NO: 18101 - protein, 9 aa, Artificial Sequence
  Description of Artificial Sequence: Synthetic peptide
  Seed: KAGKGQTGV (PTEN R130Q)
KMGKGQTGV

SEQ ID NO: 18102 - protein, 10 aa, Artificial Sequence
  Description of Artificial Sequence: Synthetic peptide
  Seed: KAGKGQTGVM (PTEN R130Q)
KMGKGQTGVF

SEQ ID NO: 18103 - protein, 10 aa, Artificial Sequence
  Description of Artificial Sequence: Synthetic peptide
  Seed: KAGKGQTGVM (PTEN R130Q)
KMGKGQTGVY

SEQ ID NO: 18104 - protein, 9 aa, Artificial Sequence
  Description of Artificial Sequence: Synthetic peptide
  Seed: KAGKGQTGV (PTEN R130Q)
KMGKGQTGY

SEQ ID NO: 18105 - protein, 11 aa, Artificial Sequence
  Description of Artificial Sequence: Synthetic peptide
  Seed: KGQTGVMICAY (PTEN R130Q)
KMQTGVMICAF

SEQ ID NO: 18106 - protein, 9 aa, Artificial Sequence
  Description of Artificial Sequence: Synthetic peptide
  Seed: KAGKGQTGV (PTEN R130Q)
KQGKGQTGF

SEQ ID NO: 18107 - protein, 9 aa, Artificial Sequence
  Description of Artificial Sequence: Synthetic peptide
  Seed: KAGKGQTGV (PTEN R130Q)
KQGKGQTGI

SEQ ID NO: 18108 - protein, 9 aa, Artificial Sequence
  Description of Artificial Sequence: Synthetic peptide
  Seed: KAGKGQTGV (PTEN R130Q)
KQGKGQTGL

SEQ ID NO: 18109 - protein, 9 aa, Artificial Sequence
  Description of Artificial Sequence: Synthetic peptide
  Seed: KAGKGQTGV (PTEN R130Q)
KQGKGQTGM

SEQ ID NO: 18110 - protein, 10 aa, Artificial Sequence
  Description of Artificial Sequence: Synthetic peptide
  Seed: KAGKGQTGVM (PTEN R130Q)
KQGKGQTGVF

SEQ ID NO: 18111 - protein, 10 aa, Artificial Sequence
  Description of Artificial Sequence: Synthetic peptide
  Seed: KAGKGQTGVM (PTEN R130Q)
KQGKGQTGVY

SEQ ID NO: 18112 - protein, 9 aa, Artificial Sequence
  Description of Artificial Sequence: Synthetic peptide
  Seed: KAGKGQTGV (PTEN R130Q)
KQGKGQTGY

SEQ ID NO: 18113 - protein, 9 aa, Artificial Sequence
  Description of Artificial Sequence: Synthetic peptide
  Seed: KAGKGQTGV (PTEN R130Q)
KSGKGQTGF

SEQ ID NO: 18114 - protein, 9 aa, Artificial Sequence
  Description of Artificial Sequence: Synthetic peptide
  Seed: KAGKGQTGV (PTEN R130Q)
KSGKGQTGI

SEQ ID NO: 18115 - protein, 9 aa, Artificial Sequence
  Description of Artificial Sequence: Synthetic peptide
  Seed: KAGKGQTGV (PTEN R130Q)
KSGKGQTGL

SEQ ID NO: 18116 - protein, 9 aa, Artificial Sequence
  Description of Artificial Sequence: Synthetic peptide
  Seed: KAGKGQTGV (PTEN R130Q)
KSGKGQTGM

SEQ ID NO: 18117 - protein, 9 aa, Artificial Sequence
  Description of Artificial Sequence: Synthetic peptide
  Seed: KAGKGQTGV (PTEN R130Q)
KSGKGQTGV

SEQ ID NO: 18118 - protein, 10 aa, Artificial Sequence
  Description of Artificial Sequence: Synthetic peptide
  Seed: KAGKGQTGVM (PTEN R130Q)
KSGKGQTGVF

SEQ ID NO: 18119 - protein, 10 aa, Artificial Sequence
  Description of Artificial Sequence: Synthetic peptide
  Seed: KAGKGQTGVM (PTEN R130Q)
KSGKGQTGVL

SEQ ID NO: 18120 - protein, 10 aa, Artificial Sequence
  Description of Artificial Sequence: Synthetic peptide
  Seed: KAGKGQTGVM (PTEN R130Q)
KSGKGQTGVM

SEQ ID NO: 18121 - protein, 11 aa, Artificial Sequence
  Description of Artificial Sequence: Synthetic peptide
  Seed: KAGKGQTGVMI (PTEN R130Q)
KSGKGQTGVML

SEQ ID NO: 18122 - protein, 10 aa, Artificial Sequence
  Description of Artificial Sequence: Synthetic peptide
  Seed: KAGKGQTGVM (PTEN R130Q)
KSGKGQTGVY

SEQ ID NO: 18123 - protein, 9 aa, Artificial Sequence
  Description of Artificial Sequence: Synthetic peptide
  Seed: KAGKGQTGV (PTEN R130Q)
KSGKGQTGY

SEQ ID NO: 18124 - protein, 9 aa, Artificial Sequence
  Description of Artificial Sequence: Synthetic peptide
  Seed: KAGKGQTGV (PTEN R130Q)
KTGKGQTGF

SEQ ID NO: 18125 - protein, 9 aa, Artificial Sequence
  Description of Artificial Sequence: Synthetic peptide
  Seed: KAGKGQTGV (PTEN R130Q)
KTGKGQTGI

SEQ ID NO: 18126 - protein, 9 aa, Artificial Sequence
  Description of Artificial Sequence: Synthetic peptide
  Seed: KAGKGQTGV (PTEN R130Q)
KTGKGQTGL

SEQ ID NO: 18127 - protein, 9 aa, Artificial Sequence
  Description of Artificial Sequence: Synthetic peptide
  Seed: KAGKGQTGV (PTEN R130Q)
KTGKGQTGM

SEQ ID NO: 18128 - protein, 9 aa, Artificial Sequence
  Description of Artificial Sequence: Synthetic peptide
  Seed: KAGKGQTGV (PTEN R130Q)
KTGKGQTGV

SEQ ID NO: 18129 - protein, 10 aa, Artificial Sequence
  Description of Artificial Sequence: Synthetic peptide
  Seed: KAGKGQTGVM (PTEN R130Q)
KTGKGQTGVF

SEQ ID NO: 18130 - protein, 10 aa, Artificial Sequence
  Description of Artificial Sequence: Synthetic peptide
  Seed: KAGKGQTGVM (PTEN R130Q)
KTGKGQTGVL

SEQ ID NO: 18131 - protein, 10 aa, Artificial Sequence
  Description of Artificial Sequence: Synthetic peptide
  Seed: KAGKGQTGVM (PTEN R130Q)
KTGKGQTGVM

SEQ ID NO: 18132 - protein, 11 aa, Artificial Sequence
  Description of Artificial Sequence: Synthetic peptide
  Seed: KAGKGQTGVMI (PTEN R130Q)
KTGKGQTGVML

SEQ ID NO: 18133 - protein, 11 aa, Artificial Sequence
  Description of Artificial Sequence: Synthetic peptide
  Seed: KAGKGQTGVMI (PTEN R130Q)
KTGKGQTGVMM

SEQ ID NO: 18134 - protein, 10 aa, Artificial Sequence
  Description of Artificial Sequence: Synthetic peptide
  Seed: KAGKGQTGVM (PTEN R130Q)
KTGKGQTGVY

SEQ ID NO: 18135 - protein, 9 aa, Artificial Sequence
  Description of Artificial Sequence: Synthetic peptide
  Seed: KAGKGQTGV (PTEN R130Q)
KTGKGQTGY

SEQ ID NO: 18136 - protein, 11 aa, Artificial Sequence
  Description of Artificial Sequence: Synthetic peptide
  Seed: KGQTGVMICAY (PTEN R130Q)
KTQTGVMICAF

SEQ ID NO: 18137 - protein, 9 aa, Artificial Sequence
  Description of Artificial Sequence: Synthetic peptide
  Seed: KAGKGQTGV (PTEN R130Q)
KVGKGQTGF

SEQ ID NO: 18138 - protein, 9 aa, Artificial Sequence
  Description of Artificial Sequence: Synthetic peptide
  Seed: KAGKGQTGV (PTEN R130Q)
KVGKGQTGI

SEQ ID NO: 18139 - protein, 9 aa, Artificial Sequence
  Description of Artificial Sequence: Synthetic peptide
  Seed: KAGKGQTGV (PTEN R130Q)
KVGKGQTGL

SEQ ID NO: 18140 - protein, 9 aa, Artificial Sequence
  Description of Artificial Sequence: Synthetic peptide
  Seed: KAGKGQTGV (PTEN R130Q)
KVGKGQTGM

SEQ ID NO: 18141 - protein, 10 aa, Artificial Sequence
  Description of Artificial Sequence: Synthetic peptide
  Seed: KAGKGQTGVM (PTEN R130Q)
KVGKGQTGVF

SEQ ID NO: 18142 - protein, 10 aa, Artificial Sequence
  Description of Artificial Sequence: Synthetic peptide
  Seed: KAGKGQTGVM (PTEN R130Q)
KVGKGQTGVM

SEQ ID NO: 18143 - protein, 10 aa, Artificial Sequence
  Description of Artificial Sequence: Synthetic peptide
  Seed: KAGKGQTGVM (PTEN R130Q)
KVGKGQTGVY

SEQ ID NO: 18144 - protein, 9 aa, Artificial Sequence
  Description of Artificial Sequence: Synthetic peptide
  Seed: KAGKGQTGV (PTEN R130Q)
KVGKGQTGY

SEQ ID NO: 18145 - protein, 11 aa, Artificial Sequence
  Description of Artificial Sequence: Synthetic peptide
  Seed: KGQTGVMICAY (PTEN R130Q)
KVQTGVMICAF

SEQ ID NO: 18146 - protein, 9 aa, Artificial Sequence
  Description of Artificial Sequence: Synthetic peptide
  Seed: QTGVMICAY (PTEN R130Q)
QAGVMICAH

SEQ ID NO: 18147 - protein, 9 aa, Artificial Sequence
  Description of Artificial Sequence: Synthetic peptide
  Seed: QTGVMICAY (PTEN R130Q)
QAGVMICAI

SEQ ID NO: 18148 - protein, 9 aa, Artificial Sequence
  Description of Artificial Sequence: Synthetic peptide
  Seed: QTGVMICAY (PTEN R130Q)
QAGVMICAK

SEQ ID NO: 18149 - protein, 9 aa, Artificial Sequence
  Description of Artificial Sequence: Synthetic peptide
  Seed: QTGVMICAY (PTEN R130Q)
QAGVMICAL

SEQ ID NO: 18150 - protein, 9 aa, Artificial Sequence
  Description of Artificial Sequence: Synthetic peptide
  Seed: QTGVMICAY (PTEN R130Q)
QAGVMICAM

SEQ ID NO: 18151 - protein, 9 aa, Artificial Sequence
  Description of Artificial Sequence: Synthetic peptide
  Seed: QTGVMICAY (PTEN R130Q)
QAGVMICAR

SEQ ID NO: 18152 - protein, 9 aa, Artificial Sequence
  Description of Artificial Sequence: Synthetic peptide
  Seed: QTGVMICAY (PTEN R130Q)
QAGVMICAV

SEQ ID NO: 18153 - protein, 9 aa, Artificial Sequence
  Description of Artificial Sequence: Synthetic peptide
  Seed: QTGVMICAY (PTEN R130Q)
QCGVMICAK

SEQ ID NO: 18154 - protein, 9 aa, Artificial Sequence
  Description of Artificial Sequence: Synthetic peptide
  Seed: QTGVMICAY (PTEN R130Q)
QCGVMICAR

SEQ ID NO: 18155 - protein, 9 aa, Artificial Sequence
  Description of Artificial Sequence: Synthetic peptide
  Seed: QTGVMICAY (PTEN R130Q)
QCGVMICAY

SEQ ID NO: 18156 - protein, 9 aa, Artificial Sequence
  Description of Artificial Sequence: Synthetic peptide
  Seed: QTGVMICAY (PTEN R130Q)
QDGVMICAK

SEQ ID NO: 18157 - protein, 9 aa, Artificial Sequence
  Description of Artificial Sequence: Synthetic peptide
  Seed: QTGVMICAY (PTEN R130Q)
QDGVMICAR

SEQ ID NO: 18158 - protein, 9 aa, Artificial Sequence
  Description of Artificial Sequence: Synthetic peptide
  Seed: QTGVMICAY (PTEN R130Q)
QDGVMICAY

SEQ ID NO: 18159 - protein, 9 aa, Artificial Sequence
  Description of Artificial Sequence: Synthetic peptide
  Seed: QTGVMICAY (PTEN R130Q)
QEGVMICAF

SEQ ID NO: 18160 - protein, 9 aa, Artificial Sequence
  Description of Artificial Sequence: Synthetic peptide
  Seed: QTGVMICAY (PTEN R130Q)
QEGVMICAK

SEQ ID NO: 18161 - protein, 9 aa, Artificial Sequence
  Description of Artificial Sequence: Synthetic peptide
  Seed: QTGVMICAY (PTEN R130Q)
QEGVMICAR

SEQ ID NO: 18162 - protein, 9 aa, Artificial Sequence
  Description of Artificial Sequence: Synthetic peptide
  Seed: QTGVMICAY (PTEN R130Q)
QEGVMICAY

SEQ ID NO: 18163 - protein, 9 aa, Artificial Sequence
  Description of Artificial Sequence: Synthetic peptide
  Seed: QTGVMICAY (PTEN R130Q)
QFGVMICAF

SEQ ID NO: 18164 - protein, 9 aa, Artificial Sequence
  Description of Artificial Sequence: Synthetic peptide
  Seed: QTGVMICAY (PTEN R130Q)
QFGVMICAK

SEQ ID NO: 18165 - protein, 9 aa, Artificial Sequence
  Description of Artificial Sequence: Synthetic peptide
  Seed: QTGVMICAY (PTEN R130Q)
QGGVMICAF

SEQ ID NO: 18166 - protein, 9 aa, Artificial Sequence
  Description of Artificial Sequence: Synthetic peptide
  Seed: QTGVMICAY (PTEN R130Q)
QGGVMICAK

SEQ ID NO: 18167 - protein, 9 aa, Artificial Sequence
  Description of Artificial Sequence: Synthetic peptide
  Seed: QTGVMICAY (PTEN R130Q)
QGGVMICAR

SEQ ID NO: 18168 - protein, 9 aa, Artificial Sequence
  Description of Artificial Sequence: Synthetic peptide
  Seed: QTGVMICAY (PTEN R130Q)
QHGVMICAY

SEQ ID NO: 18169 - protein, 9 aa, Artificial Sequence
  Description of Artificial Sequence: Synthetic peptide
  Seed: QTGVMICAY (PTEN R130Q)
QIGVMICAK

SEQ ID NO: 18170 - protein, 9 aa, Artificial Sequence
  Description of Artificial Sequence: Synthetic peptide
  Seed: QTGVMICAY (PTEN R130Q)
QIGVMICAM

SEQ ID NO: 18171 - protein, 9 aa, Artificial Sequence
  Description of Artificial Sequence: Synthetic peptide
  Seed: QTGVMICAY (PTEN R130Q)
QIGVMICAR

SEQ ID NO: 18172 - protein, 9 aa, Artificial Sequence
  Description of Artificial Sequence: Synthetic peptide
  Seed: QTGVMICAY (PTEN R130Q)
QIGVMICAW

SEQ ID NO: 18173 - protein, 9 aa, Artificial Sequence
  Description of Artificial Sequence: Synthetic peptide
  Seed: QTGVMICAY (PTEN R130Q)
QKGVMICAY

SEQ ID NO: 18174 - protein, 9 aa, Artificial Sequence
  Description of Artificial Sequence: Synthetic peptide
  Seed: QTGVMICAY (PTEN R130Q)
QLGVMICAK

SEQ ID NO: 18175 - protein, 9 aa, Artificial Sequence
  Description of Artificial Sequence: Synthetic peptide
  Seed: QTGVMICAY (PTEN R130Q)
QLGVMICAR

SEQ ID NO: 18176 - protein, 9 aa, Artificial Sequence
  Description of Artificial Sequence: Synthetic peptide
  Seed: QTGVMICAY (PTEN R130Q)
QMGVMICAK

SEQ ID NO: 18177 - protein, 9 aa, Artificial Sequence
  Description of Artificial Sequence: Synthetic peptide
  Seed: QTGVMICAY (PTEN R130Q)
QMGVMICAR

SEQ ID NO: 18178 - protein, 9 aa, Artificial Sequence
  Description of Artificial Sequence: Synthetic peptide
  Seed: QTGVMICAY (PTEN R130Q)
QNGVMICAF

SEQ ID NO: 18179 - protein, 9 aa, Artificial Sequence
  Description of Artificial Sequence: Synthetic peptide
  Seed: QTGVMICAY (PTEN R130Q)
QNGVMICAK

SEQ ID NO: 18180 - protein, 9 aa, Artificial Sequence
  Description of Artificial Sequence: Synthetic peptide
  Seed: QTGVMICAY (PTEN R130Q)
QNGVMICAR

SEQ ID NO: 18181 - protein, 9 aa, Artificial Sequence
  Description of Artificial Sequence: Synthetic peptide
  Seed: QTGVMICAY (PTEN R130Q)
QNGVMICAY

SEQ ID NO: 18182 - protein, 9 aa, Artificial Sequence
  Description of Artificial Sequence: Synthetic peptide
  Seed: QTGVMICAY (PTEN R130Q)
QPGVMICAF

SEQ ID NO: 18183 - protein, 9 aa, Artificial Sequence
  Description of Artificial Sequence: Synthetic peptide
  Seed: QTGVMICAY (PTEN R130Q)
QPGVMICAK

SEQ ID NO: 18184 - protein, 9 aa, Artificial Sequence
  Description of Artificial Sequence: Synthetic peptide
  Seed: QTGVMICAY (PTEN R130Q)
QPGVMICAR

SEQ ID NO: 18185 - protein, 9 aa, Artificial Sequence
  Description of Artificial Sequence: Synthetic peptide
  Seed: QTGVMICAY (PTEN R130Q)
QPGVMICAY

SEQ ID NO: 18186 - protein, 9 aa, Artificial Sequence
  Description of Artificial Sequence: Synthetic peptide
  Seed: QTGVMICAY (PTEN R130Q)
QQGVMICAK

SEQ ID NO: 18187 - protein, 9 aa, Artificial Sequence
  Description of Artificial Sequence: Synthetic peptide
  Seed: QTGVMICAY (PTEN R130Q)
QQGVMICAR

SEQ ID NO: 18188 - protein, 9 aa, Artificial Sequence
  Description of Artificial Sequence: Synthetic peptide
  Seed: QTGVMICAY (PTEN R130Q)
QRGVMICAY

SEQ ID NO: 18189 - protein, 9 aa, Artificial Sequence
  Description of Artificial Sequence: Synthetic peptide
  Seed: QTGVMICAY (PTEN R130Q)
QSGVMICAK

SEQ ID NO: 18190 - protein, 9 aa, Artificial Sequence
  Description of Artificial Sequence: Synthetic peptide
  Seed: QTGVMICAY (PTEN R130Q)
QSGVMICAL

SEQ ID NO: 18191 - protein, 9 aa, Artificial Sequence
  Description of Artificial Sequence: Synthetic peptide
  Seed: QTGVMICAY (PTEN R130Q)
QSGVMICAM

SEQ ID NO: 18192 - protein, 9 aa, Artificial Sequence
  Description of Artificial Sequence: Synthetic peptide
  Seed: QTGVMICAY (PTEN R130Q)
QSGVMICAR

SEQ ID NO: 18193 - protein, 9 aa, Artificial Sequence
  Description of Artificial Sequence: Synthetic peptide
  Seed: QTGVMICAY (PTEN R130Q)
QTGVMICAH

SEQ ID NO: 18194 - protein, 9 aa, Artificial Sequence
  Description of Artificial Sequence: Synthetic peptide
  Seed: QTGVMICAY (PTEN R130Q)
QTGVMICAL

SEQ ID NO: 18195 - protein, 9 aa, Artificial Sequence
  Description of Artificial Sequence: Synthetic peptide
  Seed: QTGVMICAY (PTEN R130Q)
QTGVMICAM

SEQ ID NO: 18196 - protein, 9 aa, Artificial Sequence
  Description of Artificial Sequence: Synthetic peptide
  Seed: QTGVMICAY (PTEN R130Q)
QVGVMICAH

SEQ ID NO: 18197 - protein, 9 aa, Artificial Sequence
  Description of Artificial Sequence: Synthetic peptide
  Seed: QTGVMICAY (PTEN R130Q)
QVGVMICAM

SEQ ID NO: 18198 - protein, 9 aa, Artificial Sequence
  Description of Artificial Sequence: Synthetic peptide
  Seed: QTGVMICAY (PTEN R130Q)
QVGVMICAW

SEQ ID NO: 18199 - protein, 11 aa, Homo sapiens
  Native (PTEN R130Q)
KGQTGVMICAY

SEQ ID NO: 18200 - protein, 9 aa, Homo sapiens
  Native (PTEN R130Q)
QTGVMICAY

SEQ ID NO: 18201 - protein, 10 aa, Homo sapiens
  Native (PTEN R130Q)
QTGVMICAYL

SEQ ID NO: 18202 - protein, 9 aa, Homo sapiens
  Native (PTEN R130Q)
AGKGQTGVM

SEQ ID NO: 18203 - protein, 9 aa, Homo sapiens
  Native (PTEN R130Q)
KAGKGQTGV

SEQ ID NO: 18204 - protein, 10 aa, Homo sapiens
  Native (PTEN R130Q)
KAGKGQTGVM

SEQ ID NO: 18205 - protein, 11 aa, Homo sapiens
  Native (PTEN R130Q)
KAGKGQTGVMI

SEQ ID NO: 18206 - protein, 11 aa, Artificial Sequence
  Description of Artificial Sequence: Synthetic peptide
  Seed: EVVRRCPHRER (TP53 H179R)
EIVRRCPHRER

SEQ ID NO: 18207 - protein, 11 aa, Artificial Sequence
  Description of Artificial Sequence: Synthetic peptide
  Seed: EVVRRCPHRER (TP53 H179R)
ELVRRCPHRER

SEQ ID NO: 18208 - protein, 11 aa, Artificial Sequence
  Description of Artificial Sequence: Synthetic peptide
  Seed: EVVRRCPHRER (TP53 H179R)
EMVRRCPHRER

SEQ ID NO: 18209 - protein, 11 aa, Artificial Sequence
  Description of Artificial Sequence: Synthetic peptide
  Seed: EVVRRCPHRER (TP53 H179R)
ESVRRCPHRER

SEQ ID NO: 18210 - protein, 11 aa, Artificial Sequence
  Description of Artificial Sequence: Synthetic peptide
  Seed: EVVRRCPHRER (TP53 H179R)
ETVRRCPHREK

SEQ ID NO: 18211 - protein, 11 aa, Artificial Sequence
  Description of Artificial Sequence: Synthetic peptide
  Seed: EVVRRCPHRER (TP53 H179R)
ETVRRCPHRER

SEQ ID NO: 18212 - protein, 11 aa, Artificial Sequence
  Description of Artificial Sequence: Synthetic peptide
  Seed: EVVRRCPHRER (TP53 H179R)
EVVRRCPHREK

SEQ ID NO: 18213 - protein, 11 aa, Artificial Sequence
  Description of Artificial Sequence: Synthetic peptide
  Seed: EVVRRCPHRER (TP53 H179R)
EYVRRCPHRER

SEQ ID NO: 18214 - protein, 10 aa, Artificial Sequence
  Description of Artificial Sequence: Synthetic peptide
  Seed: RERCSDSDGL (TP53 H179R)
RERCSDSDGF

SEQ ID NO: 18215 - protein, 10 aa, Artificial Sequence
  Description of Artificial Sequence: Synthetic peptide
  Seed: RERCSDSDGL (TP53 H179R)
RERCSDSDGI

SEQ ID NO: 18216 - protein, 10 aa, Artificial Sequence
  Description of Artificial Sequence: Synthetic peptide
  Seed: RERCSDSDGL (TP53 H179R)
RERCSDSDGM

SEQ ID NO: 18217 - protein, 10 aa, Artificial Sequence
  Description of Artificial Sequence: Synthetic peptide
  Seed: RERCSDSDGL (TP53 H179R)
RERCSDSDGV

SEQ ID NO: 18218 - protein, 10 aa, Artificial Sequence
  Description of Artificial Sequence: Synthetic peptide
  Seed: VVRRCPHRER (TP53 H179R)
VARRCPHRER

SEQ ID NO: 18219 - protein, 10 aa, Artificial Sequence
  Description of Artificial Sequence: Synthetic peptide
  Seed: VVRRCPHRER (TP53 H179R)
VFRRCPHREK

SEQ ID NO: 18220 - protein, 10 aa, Artificial Sequence
  Description of Artificial Sequence: Synthetic peptide
  Seed: VVRRCPHRER (TP53 H179R)
VFRRCPHRER

SEQ ID NO: 18221 - protein, 10 aa, Artificial Sequence
  Description of Artificial Sequence: Synthetic peptide
  Seed: VVRRCPHRER (TP53 H179R)
VIRRCPHRER

SEQ ID NO: 18222 - protein, 10 aa, Artificial Sequence
  Description of Artificial Sequence: Synthetic peptide
  Seed: VVRRCPHRER (TP53 H179R)
VLRRCPHREK

SEQ ID NO: 18223 - protein, 10 aa, Artificial Sequence
  Description of Artificial Sequence: Synthetic peptide
  Seed: VVRRCPHRER (TP53 H179R)
VLRRCPHRER

SEQ ID NO: 18224 - protein, 10 aa, Artificial Sequence
  Description of Artificial Sequence: Synthetic peptide
  Seed: VVRRCPHRER (TP53 H179R)
VMRRCPHREK

SEQ ID NO: 18225 - protein, 10 aa, Artificial Sequence
  Description of Artificial Sequence: Synthetic peptide
  Seed: VVRRCPHRER (TP53 H179R)
VQRRCPHRER

SEQ ID NO: 18226 - protein, 10 aa, Artificial Sequence
  Description of Artificial Sequence: Synthetic peptide
  Seed: VVRRCPHRER (TP53 H179R)
VSRRCPHRER

SEQ ID NO: 18227 - protein, 10 aa, Artificial Sequence
  Description of Artificial Sequence: Synthetic peptide
  Seed: VVRRCPHRER (TP53 H179R)
VTRRCPHRER

SEQ ID NO: 18228 - protein, 10 aa, Artificial Sequence
  Description of Artificial Sequence: Synthetic peptide
  Seed: VVRRCPHRER (TP53 H179R)
VWRRCPHREK

SEQ ID NO: 18229 - protein, 10 aa, Artificial Sequence
  Description of Artificial Sequence: Synthetic peptide
  Seed: VVRRCPHRER (TP53 H179R)
VWRRCPHRER

SEQ ID NO: 18230 - protein, 10 aa, Artificial Sequence
  Description of Artificial Sequence: Synthetic peptide
  Seed: VVRRCPHRER (TP53 H179R)
VYRRCPHREK

SEQ ID NO: 18231 - protein, 10 aa, Artificial Sequence
  Description of Artificial Sequence: Synthetic peptide
  Seed: VVRRCPHRER (TP53 H179R)
VYRRCPHRER

SEQ ID NO: 18232 - protein, 11 aa, Artificial Sequence
  Description of Artificial Sequence: Synthetic peptide
  Seed: EVVRRCPHRER (TP53 H179R)
EAVRRCPHRER

SEQ ID NO: 18233 - protein, 11 aa, Artificial Sequence
  Description of Artificial Sequence: Synthetic peptide
  Seed: EVVRRCPHRER (TP53 H179R)
EWVRRCPHRER

SEQ ID NO: 18234 - protein, 9 aa, Artificial Sequence
  Description of Artificial Sequence: Synthetic peptide
  Seed: RRCPHRERC (TP53 H179R)
RACPHRERF

SEQ ID NO: 18235 - protein, 9 aa, Artificial Sequence
  Description of Artificial Sequence: Synthetic peptide
  Seed: RRCPHRERC (TP53 H179R)
RACPHRERI

SEQ ID NO: 18236 - protein, 9 aa, Artificial Sequence
  Description of Artificial Sequence: Synthetic peptide
  Seed: RRCPHRERC (TP53 H179R)
RACPHRERK

SEQ ID NO: 18237 - protein, 9 aa, Artificial Sequence
  Description of Artificial Sequence: Synthetic peptide
  Seed: RRCPHRERC (TP53 H179R)
RACPHRERL

SEQ ID NO: 18238 - protein, 9 aa, Artificial Sequence
  Description of Artificial Sequence: Synthetic peptide
  Seed: RRCPHRERC (TP53 H179R)
RACPHRERM

SEQ ID NO: 18239 - protein, 9 aa, Artificial Sequence
  Description of Artificial Sequence: Synthetic peptide
  Seed: RRCPHRERC (TP53 H179R)
RACPHRERV

SEQ ID NO: 18240 - protein, 9 aa, Artificial Sequence
  Description of Artificial Sequence: Synthetic peptide
  Seed: RRCPHRERC (TP53 H179R)
RACPHRERY

SEQ ID NO: 18241 - protein, 9 aa, Artificial Sequence
  Description of Artificial Sequence: Synthetic peptide
  Seed: RRCPHRERC (TP53 H179R)
RCCPHRERL

SEQ ID NO: 18242 - protein, 9 aa, Artificial Sequence
  Description of Artificial Sequence: Synthetic peptide
  Seed: RRCPHRERC (TP53 H179R)
RDCPHRERF

SEQ ID NO: 18243 - protein, 9 aa, Artificial Sequence
  Description of Artificial Sequence: Synthetic peptide
  Seed: RRCPHRERC (TP53 H179R)
RDCPHRERI

SEQ ID NO: 18244 - protein, 9 aa, Artificial Sequence
  Description of Artificial Sequence: Synthetic peptide
  Seed: RRCPHRERC (TP53 H179R)
RDCPHRERK

SEQ ID NO: 18245 - protein, 9 aa, Artificial Sequence
  Description of Artificial Sequence: Synthetic peptide
  Seed: RRCPHRERC (TP53 H179R)
RDCPHRERL

SEQ ID NO: 18246 - protein, 9 aa, Artificial Sequence
  Description of Artificial Sequence: Synthetic peptide
  Seed: RRCPHRERC (TP53 H179R)
RDCPHRERM

SEQ ID NO: 18247 - protein, 9 aa, Artificial Sequence
  Description of Artificial Sequence: Synthetic peptide
  Seed: RRCPHRERC (TP53 H179R)
RDCPHRERV

SEQ ID NO: 18248 - protein, 10 aa, Artificial Sequence
  Description of Artificial Sequence: Synthetic peptide
  Seed: RERCSDSDGL (TP53 H179R)
RDRCSDSDGW

SEQ ID NO: 18249 - protein, 9 aa, Artificial Sequence
  Description of Artificial Sequence: Synthetic peptide
  Seed: RRCPHRERC (TP53 H179R)
RECPHRERF

SEQ ID NO: 18250 - protein, 9 aa, Artificial Sequence
  Description of Artificial Sequence: Synthetic peptide
  Seed: RRCPHRERC (TP53 H179R)
RECPHRERI

SEQ ID NO: 18251 - protein, 9 aa, Artificial Sequence
  Description of Artificial Sequence: Synthetic peptide
  Seed: RRCPHRERC (TP53 H179R)
RECPHRERK

SEQ ID NO: 18252 - protein, 9 aa, Artificial Sequence
  Description of Artificial Sequence: Synthetic peptide
  Seed: RRCPHRERC (TP53 H179R)
RECPHRERL

SEQ ID NO: 18253 - protein, 9 aa, Artificial Sequence
  Description of Artificial Sequence: Synthetic peptide
  Seed: RRCPHRERC (TP53 H179R)
RECPHRERM

SEQ ID NO: 18254 - protein, 9 aa, Artificial Sequence
  Description of Artificial Sequence: Synthetic peptide
  Seed: RRCPHRERC (TP53 H179R)
RECPHRERR

SEQ ID NO: 18255 - protein, 9 aa, Artificial Sequence
  Description of Artificial Sequence: Synthetic peptide
  Seed: RRCPHRERC (TP53 H179R)
RECPHRERV

SEQ ID NO: 18256 - protein, 9 aa, Artificial Sequence
  Description of Artificial Sequence: Synthetic peptide
  Seed: RRCPHRERC (TP53 H179R)
RECPHRERY

SEQ ID NO: 18257 - protein, 10 aa, Artificial Sequence
  Description of Artificial Sequence: Synthetic peptide
  Seed: RERCSDSDGL (TP53 H179R)
RERCSDSDGA

SEQ ID NO: 18258 - protein, 10 aa, Artificial Sequence
  Description of Artificial Sequence: Synthetic peptide
  Seed: RERCSDSDGL (TP53 H179R)
RERCSDSDGC

SEQ ID NO: 18259 - protein, 11 aa, Artificial Sequence
  Description of Artificial Sequence: Synthetic peptide
  Seed: RERCSDSDGLA (TP53 H179R)
RERCSDSDGLC

SEQ ID NO: 18260 - protein, 11 aa, Artificial Sequence
  Description of Artificial Sequence: Synthetic peptide
  Seed: RERCSDSDGLA (TP53 H179R)
RERCSDSDGLF

SEQ ID NO: 18261 - protein, 11 aa, Artificial Sequence
  Description of Artificial Sequence: Synthetic peptide
  Seed: RERCSDSDGLA (TP53 H179R)
RERCSDSDGLI

SEQ ID NO: 18262 - protein, 11 aa, Artificial Sequence
  Description of Artificial Sequence: Synthetic peptide
  Seed: RERCSDSDGLA (TP53 H179R)
RERCSDSDGLL

SEQ ID NO: 18263 - protein, 11 aa, Artificial Sequence
  Description of Artificial Sequence: Synthetic peptide
  Seed: RERCSDSDGLA (TP53 H179R)
RERCSDSDGLM

SEQ ID NO: 18264 - protein, 11 aa, Artificial Sequence
  Description of Artificial Sequence: Synthetic peptide
  Seed: RERCSDSDGLA (TP53 H179R)
RERCSDSDGLP

SEQ ID NO: 18265 - protein, 11 aa, Artificial Sequence
  Description of Artificial Sequence: Synthetic peptide
  Seed: RERCSDSDGLA (TP53 H179R)
RERCSDSDGLT

SEQ ID NO: 18266 - protein, 11 aa, Artificial Sequence
  Description of Artificial Sequence: Synthetic peptide
  Seed: RERCSDSDGLA (TP53 H179R)
RERCSDSDGLV

SEQ ID NO: 18267 - protein, 10 aa, Artificial Sequence
  Description of Artificial Sequence: Synthetic peptide
  Seed: RERCSDSDGL (TP53 H179R)
RERCSDSDGP

SEQ ID NO: 18268 - protein, 10 aa, Artificial Sequence
  Description of Artificial Sequence: Synthetic peptide
  Seed: RERCSDSDGL (TP53 H179R)
RERCSDSDGT

SEQ ID NO: 18269 - protein, 10 aa, Artificial Sequence
  Description of Artificial Sequence: Synthetic peptide
  Seed: RERCSDSDGL (TP53 H179R)
RERCSDSDGW

SEQ ID NO: 18270 - protein, 10 aa, Artificial Sequence
  Description of Artificial Sequence: Synthetic peptide
  Seed: RERCSDSDGL (TP53 H179R)
RERCSDSDGY

SEQ ID NO: 18271 - protein, 9 aa, Artificial Sequence
  Description of Artificial Sequence: Synthetic peptide
  Seed: RRCPHRERC (TP53 H179R)
RFCPHRERF

SEQ ID NO: 18272 - protein, 9 aa, Artificial Sequence
  Description of Artificial Sequence: Synthetic peptide
  Seed: RRCPHRERC (TP53 H179R)
RFCPHRERI

SEQ ID NO: 18273 - protein, 9 aa, Artificial Sequence
  Description of Artificial Sequence: Synthetic peptide
  Seed: RRCPHRERC (TP53 H179R)
RFCPHRERL

SEQ ID NO: 18274 - protein, 9 aa, Artificial Sequence
  Description of Artificial Sequence: Synthetic peptide
  Seed: RRCPHRERC (TP53 H179R)
RFCPHRERM

SEQ ID NO: 18275 - protein, 9 aa, Artificial Sequence
  Description of Artificial Sequence: Synthetic peptide
  Seed: RRCPHRERC (TP53 H179R)
RFCPHRERV

SEQ ID NO: 18276 - protein, 9 aa, Artificial Sequence
  Description of Artificial Sequence: Synthetic peptide
  Seed: RRCPHRERC (TP53 H179R)
RFCPHRERY

SEQ ID NO: 18277 - protein, 9 aa, Artificial Sequence
  Description of Artificial Sequence: Synthetic peptide
  Seed: RRCPHRERC (TP53 H179R)
RGCPHRERF

SEQ ID NO: 18278 - protein, 9 aa, Artificial Sequence
  Description of Artificial Sequence: Synthetic peptide
  Seed: RRCPHRERC (TP53 H179R)
RGCPHRERI

SEQ ID NO: 18279 - protein, 9 aa, Artificial Sequence
  Description of Artificial Sequence: Synthetic peptide
  Seed: RRCPHRERC (TP53 H179R)
RGCPHRERK

SEQ ID NO: 18280 - protein, 9 aa, Artificial Sequence
  Description of Artificial Sequence: Synthetic peptide
  Seed: RRCPHRERC (TP53 H179R)
RGCPHRERL

SEQ ID NO: 18281 - protein, 9 aa, Artificial Sequence
  Description of Artificial Sequence: Synthetic peptide
  Seed: RRCPHRERC (TP53 H179R)
RGCPHRERM

SEQ ID NO: 18282 - protein, 9 aa, Artificial Sequence
  Description of Artificial Sequence: Synthetic peptide
  Seed: RRCPHRERC (TP53 H179R)
RGCPHRERR

SEQ ID NO: 18283 - protein, 9 aa, Artificial Sequence
  Description of Artificial Sequence: Synthetic peptide
  Seed: RRCPHRERC (TP53 H179R)
RGCPHRERV

SEQ ID NO: 18284 - protein, 9 aa, Artificial Sequence
  Description of Artificial Sequence: Synthetic peptide
  Seed: RRCPHRERC (TP53 H179R)
RGCPHRERY

SEQ ID NO: 18285 - protein, 9 aa, Artificial Sequence
  Description of Artificial Sequence: Synthetic peptide
  Seed: RRCPHRERC (TP53 H179R)
RHCPHRERF

SEQ ID NO: 18286 - protein, 9 aa, Artificial Sequence
  Description of Artificial Sequence: Synthetic peptide
  Seed: RRCPHRERC (TP53 H179R)
RHCPHRERI

SEQ ID NO: 18287 - protein, 9 aa, Artificial Sequence
  Description of Artificial Sequence: Synthetic peptide
  Seed: RRCPHRERC (TP53 H179R)
RHCPHRERL

SEQ ID NO: 18288 - protein, 9 aa, Artificial Sequence
  Description of Artificial Sequence: Synthetic peptide
  Seed: RRCPHRERC (TP53 H179R)
RHCPHRERM

SEQ ID NO: 18289 - protein, 9 aa, Artificial Sequence
  Description of Artificial Sequence: Synthetic peptide
  Seed: RRCPHRERC (TP53 H179R)
RHCPHRERV

SEQ ID NO: 18290 - protein, 9 aa, Artificial Sequence
  Description of Artificial Sequence: Synthetic peptide
  Seed: RRCPHRERC (TP53 H179R)
RHCPHRERW

SEQ ID NO: 18291 - protein, 9 aa, Artificial Sequence
  Description of Artificial Sequence: Synthetic peptide
  Seed: RRCPHRERC (TP53 H179R)
RHCPHRERY

SEQ ID NO: 18292 - protein, 9 aa, Artificial Sequence
  Description of Artificial Sequence: Synthetic peptide
  Seed: RRCPHRERC (TP53 H179R)
RICPHRERF

SEQ ID NO: 18293 - protein, 9 aa, Artificial Sequence
  Description of Artificial Sequence: Synthetic peptide
  Seed: RRCPHRERC (TP53 H179R)
RICPHRERI

SEQ ID NO: 18294 - protein, 9 aa, Artificial Sequence
  Description of Artificial Sequence: Synthetic peptide
  Seed: RRCPHRERC (TP53 H179R)
RICPHRERL

SEQ ID NO: 18295 - protein, 9 aa, Artificial Sequence
  Description of Artificial Sequence: Synthetic peptide
  Seed: RRCPHRERC (TP53 H179R)
RICPHRERM

SEQ ID NO: 18296 - protein, 9 aa, Artificial Sequence
  Description of Artificial Sequence: Synthetic peptide
  Seed: RRCPHRERC (TP53 H179R)
RICPHRERV

SEQ ID NO: 18297 - protein, 9 aa, Artificial Sequence
  Description of Artificial Sequence: Synthetic peptide
  Seed: RRCPHRERC (TP53 H179R)
RICPHRERY

SEQ ID NO: 18298 - protein, 9 aa, Artificial Sequence
  Description of Artificial Sequence: Synthetic peptide
  Seed: RRCPHRERC (TP53 H179R)
RKCPHRERF

SEQ ID NO: 18299 - protein, 9 aa, Artificial Sequence
  Description of Artificial Sequence: Synthetic peptide
  Seed: RRCPHRERC (TP53 H179R)
RKCPHRERI

SEQ ID NO: 18300 - protein, 9 aa, Artificial Sequence
  Description of Artificial Sequence: Synthetic peptide
  Seed: RRCPHRERC (TP53 H179R)
RKCPHRERK

SEQ ID NO: 18301 - protein, 9 aa, Artificial Sequence
  Description of Artificial Sequence: Synthetic peptide
  Seed: RRCPHRERC (TP53 H179R)
RKCPHRERL

SEQ ID NO: 18302 - protein, 9 aa, Artificial Sequence
  Description of Artificial Sequence: Synthetic peptide
  Seed: RRCPHRERC (TP53 H179R)
RKCPHRERM

SEQ ID NO: 18303 - protein, 9 aa, Artificial Sequence
  Description of Artificial Sequence: Synthetic peptide
  Seed: RRCPHRERC (TP53 H179R)
RKCPHRERR

SEQ ID NO: 18304 - protein, 9 aa, Artificial Sequence
  Description of Artificial Sequence: Synthetic peptide
  Seed: RRCPHRERC (TP53 H179R)
RKCPHRERV

SEQ ID NO: 18305 - protein, 9 aa, Artificial Sequence
  Description of Artificial Sequence: Synthetic peptide
  Seed: RRCPHRERC (TP53 H179R)
RKCPHRERW

SEQ ID NO: 18306 - protein, 9 aa, Artificial Sequence
  Description of Artificial Sequence: Synthetic peptide
  Seed: RRCPHRERC (TP53 H179R)
RKCPHRERY

SEQ ID NO: 18307 - protein, 9 aa, Artificial Sequence
  Description of Artificial Sequence: Synthetic peptide
  Seed: RRCPHRERC (TP53 H179R)
RLCPHRERF

SEQ ID NO: 18308 - protein, 9 aa, Artificial Sequence
  Description of Artificial Sequence: Synthetic peptide
  Seed: RRCPHRERC (TP53 H179R)
RLCPHRERI

SEQ ID NO: 18309 - protein, 9 aa, Artificial Sequence
  Description of Artificial Sequence: Synthetic peptide
  Seed: RRCPHRERC (TP53 H179R)
RLCPHRERL

SEQ ID NO: 18310 - protein, 9 aa, Artificial Sequence
  Description of Artificial Sequence: Synthetic peptide
  Seed: RRCPHRERC (TP53 H179R)
RLCPHRERM

SEQ ID NO: 18311 - protein, 9 aa, Artificial Sequence
  Description of Artificial Sequence: Synthetic peptide
  Seed: RRCPHRERC (TP53 H179R)
RLCPHRERV

SEQ ID NO: 18312 - protein, 9 aa, Artificial Sequence
  Description of Artificial Sequence: Synthetic peptide
  Seed: RRCPHRERC (TP53 H179R)
RLCPHRERY

SEQ ID NO: 18313 - protein, 9 aa, Artificial Sequence
  Description of Artificial Sequence: Synthetic peptide
  Seed: RRCPHRERC (TP53 H179R)
RMCPHRERF

SEQ ID NO: 18314 - protein, 9 aa, Artificial Sequence
  Description of Artificial Sequence: Synthetic peptide
  Seed: RRCPHRERC (TP53 H179R)
RMCPHRERI

SEQ ID NO: 18315 - protein, 9 aa, Artificial Sequence
  Description of Artificial Sequence: Synthetic peptide
  Seed: RRCPHRERC (TP53 H179R)
RMCPHRERK

SEQ ID NO: 18316 - protein, 9 aa, Artificial Sequence
  Description of Artificial Sequence: Synthetic peptide
  Seed: RRCPHRERC (TP53 H179R)
RMCPHRERL

SEQ ID NO: 18317 - protein, 9 aa, Artificial Sequence
  Description of Artificial Sequence: Synthetic peptide
  Seed: RRCPHRERC (TP53 H179R)
RMCPHRERM

SEQ ID NO: 18318 - protein, 9 aa, Artificial Sequence
  Description of Artificial Sequence: Synthetic peptide
  Seed: RRCPHRERC (TP53 H179R)
RMCPHRERV

SEQ ID NO: 18319 - protein, 9 aa, Artificial Sequence
  Description of Artificial Sequence: Synthetic peptide
  Seed: RRCPHRERC (TP53 H179R)
RMCPHRERY

SEQ ID NO: 18320 - protein, 9 aa, Artificial Sequence
  Description of Artificial Sequence: Synthetic peptide
  Seed: RRCPHRERC (TP53 H179R)
RNCPHRERF

SEQ ID NO: 18321 - protein, 9 aa, Artificial Sequence
  Description of Artificial Sequence: Synthetic peptide
  Seed: RRCPHRERC (TP53 H179R)
RNCPHRERI

SEQ ID NO: 18322 - protein, 9 aa, Artificial Sequence
  Description of Artificial Sequence: Synthetic peptide
  Seed: RRCPHRERC (TP53 H179R)
RNCPHRERK

SEQ ID NO: 18323 - protein, 9 aa, Artificial Sequence
  Description of Artificial Sequence: Synthetic peptide
  Seed: RRCPHRERC (TP53 H179R)
RNCPHRERL

SEQ ID NO: 18324 - protein, 9 aa, Artificial Sequence
  Description of Artificial Sequence: Synthetic peptide
  Seed: RRCPHRERC (TP53 H179R)
RNCPHRERM

SEQ ID NO: 18325 - protein, 9 aa, Artificial Sequence
  Description of Artificial Sequence: Synthetic peptide
  Seed: RRCPHRERC (TP53 H179R)
RNCPHRERR

SEQ ID NO: 18326 - protein, 9 aa, Artificial Sequence
  Description of Artificial Sequence: Synthetic peptide
  Seed: RRCPHRERC (TP53 H179R)
RNCPHRERV

SEQ ID NO: 18327 - protein, 9 aa, Artificial Sequence
  Description of Artificial Sequence: Synthetic peptide
  Seed: RRCPHRERC (TP53 H179R)
RNCPHRERY

SEQ ID NO: 18328 - protein, 9 aa, Artificial Sequence
  Description of Artificial Sequence: Synthetic peptide
  Seed: RRCPHRERC (TP53 H179R)
RPCPHRERF

SEQ ID NO: 18329 - protein, 9 aa, Artificial Sequence
  Description of Artificial Sequence: Synthetic peptide
  Seed: RRCPHRERC (TP53 H179R)
RPCPHRERL

SEQ ID NO: 18330 - protein, 9 aa, Artificial Sequence
  Description of Artificial Sequence: Synthetic peptide
  Seed: RRCPHRERC (TP53 H179R)
RPCPHRERM

SEQ ID NO: 18331 - protein, 9 aa, Artificial Sequence
  Description of Artificial Sequence: Synthetic peptide
  Seed: RRCPHRERC (TP53 H179R)
RPCPHRERY

SEQ ID NO: 18332 - protein, 9 aa, Artificial Sequence
  Description of Artificial Sequence: Synthetic peptide
  Seed: RRCPHRERC (TP53 H179R)
RQCPHRERA

SEQ ID NO: 18333 - protein, 9 aa, Artificial Sequence
  Description of Artificial Sequence: Synthetic peptide
  Seed: RRCPHRERC (TP53 H179R)
RQCPHRERC

SEQ ID NO: 18334 - protein, 9 aa, Artificial Sequence
  Description of Artificial Sequence: Synthetic peptide
  Seed: RRCPHRERC (TP53 H179R)
RQCPHRERF

SEQ ID NO: 18335 - protein, 9 aa, Artificial Sequence
  Description of Artificial Sequence: Synthetic peptide
  Seed: RRCPHRERC (TP53 H179R)
RQCPHRERH

SEQ ID NO: 18336 - protein, 9 aa, Artificial Sequence
  Description of Artificial Sequence: Synthetic peptide
  Seed: RRCPHRERC (TP53 H179R)
RQCPHRERI

SEQ ID NO: 18337 - protein, 9 aa, Artificial Sequence
  Description of Artificial Sequence: Synthetic peptide
  Seed: RRCPHRERC (TP53 H179R)
RQCPHRERK

SEQ ID NO: 18338 - protein, 9 aa, Artificial Sequence
  Description of Artificial Sequence: Synthetic peptide
  Seed: RRCPHRERC (TP53 H179R)
RQCPHRERM

SEQ ID NO: 18339 - protein, 9 aa, Artificial Sequence
  Description of Artificial Sequence: Synthetic peptide
  Seed: RRCPHRERC (TP53 H179R)
RQCPHRERR

SEQ ID NO: 18340 - protein, 9 aa, Artificial Sequence
  Description of Artificial Sequence: Synthetic peptide
  Seed: RRCPHRERC (TP53 H179R)
RQCPHRERV

SEQ ID NO: 18341 - protein, 9 aa, Artificial Sequence
  Description of Artificial Sequence: Synthetic peptide
  Seed: RRCPHRERC (TP53 H179R)
RQCPHRERW

SEQ ID NO: 18342 - protein, 9 aa, Artificial Sequence
  Description of Artificial Sequence: Synthetic peptide
  Seed: RRCPHRERC (TP53 H179R)
RQCPHRERY

SEQ ID NO: 18343 - protein, 10 aa, Artificial Sequence
  Description of Artificial Sequence: Synthetic peptide
  Seed: RERCSDSDGL (TP53 H179R)
RQRCSDSDGW

SEQ ID NO: 18344 - protein, 8 aa, Artificial Sequence
  Description of Artificial Sequence: Synthetic peptide
  Seed: RRCPHRER (TP53 H179R)
RRCPHREF

SEQ ID NO: 18345 - protein, 8 aa, Artificial Sequence
  Description of Artificial Sequence: Synthetic peptide
  Seed: RRCPHRER (TP53 H179R)
RRCPHREI

SEQ ID NO: 18346 - protein, 8 aa, Artificial Sequence
  Description of Artificial Sequence: Synthetic peptide
  Seed: RRCPHRER (TP53 H179R)
RRCPHREK

SEQ ID NO: 18347 - protein, 8 aa, Artificial Sequence
  Description of Artificial Sequence: Synthetic peptide
  Seed: RRCPHRER (TP53 H179R)
RRCPHREL

SEQ ID NO: 18348 - protein, 8 aa, Artificial Sequence
  Description of Artificial Sequence: Synthetic peptide
  Seed: RRCPHRER (TP53 H179R)
RRCPHREM

SEQ ID NO: 18349 - protein, 9 aa, Artificial Sequence
  Description of Artificial Sequence: Synthetic peptide
  Seed: RRCPHRERC (TP53 H179R)
RRCPHRERA

SEQ ID NO: 18350 - protein, 9 aa, Artificial Sequence
  Description of Artificial Sequence: Synthetic peptide
  Seed: RRCPHRERC (TP53 H179R)
RRCPHRERE

SEQ ID NO: 18351 - protein, 9 aa, Artificial Sequence
  Description of Artificial Sequence: Synthetic peptide
  Seed: RRCPHRERC (TP53 H179R)
RRCPHRERG

SEQ ID NO: 18352 - protein, 9 aa, Artificial Sequence
  Description of Artificial Sequence: Synthetic peptide
  Seed: RRCPHRERC (TP53 H179R)
RRCPHRERH

SEQ ID NO: 18353 - protein, 9 aa, Artificial Sequence
  Description of Artificial Sequence: Synthetic peptide
  Seed: RRCPHRERC (TP53 H179R)
RRCPHRERI

SEQ ID NO: 18354 - protein, 9 aa, Artificial Sequence
  Description of Artificial Sequence: Synthetic peptide
  Seed: RRCPHRERC (TP53 H179R)
RRCPHRERK

SEQ ID NO: 18355 - protein, 9 aa, Artificial Sequence
  Description of Artificial Sequence: Synthetic peptide
  Seed: RRCPHRERC (TP53 H179R)
RRCPHRERL

SEQ ID NO: 18356 - protein, 9 aa, Artificial Sequence
  Description of Artificial Sequence: Synthetic peptide
  Seed: RRCPHRERC (TP53 H179R)
RRCPHRERM

SEQ ID NO: 18357 - protein, 9 aa, Artificial Sequence
  Description of Artificial Sequence: Synthetic peptide
  Seed: RRCPHRERC (TP53 H179R)
RRCPHRERN

SEQ ID NO: 18358 - protein, 9 aa, Artificial Sequence
  Description of Artificial Sequence: Synthetic peptide
  Seed: RRCPHRERC (TP53 H179R)
RRCPHRERP

SEQ ID NO: 18359 - protein, 9 aa, Artificial Sequence
  Description of Artificial Sequence: Synthetic peptide
  Seed: RRCPHRERC (TP53 H179R)
RRCPHRERQ

SEQ ID NO: 18360 - protein, 9 aa, Artificial Sequence
  Description of Artificial Sequence: Synthetic peptide
  Seed: RRCPHRERC (TP53 H179R)
RRCPHRERR

SEQ ID NO: 18361 - protein, 9 aa, Artificial Sequence
  Description of Artificial Sequence: Synthetic peptide
  Seed: RRCPHRERC (TP53 H179R)
RRCPHRERS

SEQ ID NO: 18362 - protein, 9 aa, Artificial Sequence
  Description of Artificial Sequence: Synthetic peptide
  Seed: RRCPHRERC (TP53 H179R)
RRCPHRERT

SEQ ID NO: 18363 - protein, 9 aa, Artificial Sequence
  Description of Artificial Sequence: Synthetic peptide
  Seed: RRCPHRERC (TP53 H179R)
RRCPHRERV

SEQ ID NO: 18364 - protein, 9 aa, Artificial Sequence
  Description of Artificial Sequence: Synthetic peptide
  Seed: RRCPHRERC (TP53 H179R)
RRCPHRERW

SEQ ID NO: 18365 - protein, 8 aa, Artificial Sequence
  Description of Artificial Sequence: Synthetic peptide
  Seed: RRCPHRER (TP53 H179R)
RRCPHREV

SEQ ID NO: 18366 - protein, 8 aa, Artificial Sequence
  Description of Artificial Sequence: Synthetic peptide
  Seed: RRCPHRER (TP53 H179R)
RRCPHREW

SEQ ID NO: 18367 - protein, 8 aa, Artificial Sequence
  Description of Artificial Sequence: Synthetic peptide
  Seed: RRCPHRER (TP53 H179R)
RRCPHREY

SEQ ID NO: 18368 - protein, 9 aa, Artificial Sequence
  Description of Artificial Sequence: Synthetic peptide
  Seed: RRCPHRERC (TP53 H179R)
RSCPHRERF

SEQ ID NO: 18369 - protein, 9 aa, Artificial Sequence
  Description of Artificial Sequence: Synthetic peptide
  Seed: RRCPHRERC (TP53 H179R)
RSCPHRERI

SEQ ID NO: 18370 - protein, 9 aa, Artificial Sequence
  Description of Artificial Sequence: Synthetic peptide
  Seed: RRCPHRERC (TP53 H179R)
RSCPHRERK

SEQ ID NO: 18371 - protein, 9 aa, Artificial Sequence
  Description of Artificial Sequence: Synthetic peptide
  Seed: RRCPHRERC (TP53 H179R)
RSCPHRERL

SEQ ID NO: 18372 - protein, 9 aa, Artificial Sequence
  Description of Artificial Sequence: Synthetic peptide
  Seed: RRCPHRERC (TP53 H179R)
RSCPHRERM

SEQ ID NO: 18373 - protein, 9 aa, Artificial Sequence
  Description of Artificial Sequence: Synthetic peptide
  Seed: RRCPHRERC (TP53 H179R)
RSCPHRERV

SEQ ID NO: 18374 - protein, 9 aa, Artificial Sequence
  Description of Artificial Sequence: Synthetic peptide
  Seed: RRCPHRERC (TP53 H179R)
RSCPHRERY

SEQ ID NO: 18375 - protein, 9 aa, Artificial Sequence
  Description of Artificial Sequence: Synthetic peptide
  Seed: RRCPHRERC (TP53 H179R)
RTCPHRERF

SEQ ID NO: 18376 - protein, 9 aa, Artificial Sequence
  Description of Artificial Sequence: Synthetic peptide
  Seed: RRCPHRERC (TP53 H179R)
RTCPHRERI

SEQ ID NO: 18377 - protein, 9 aa, Artificial Sequence
  Description of Artificial Sequence: Synthetic peptide
  Seed: RRCPHRERC (TP53 H179R)
RTCPHRERL

SEQ ID NO: 18378 - protein, 9 aa, Artificial Sequence
  Description of Artificial Sequence: Synthetic peptide
  Seed: RRCPHRERC (TP53 H179R)
RTCPHRERM

SEQ ID NO: 18379 - protein, 9 aa, Artificial Sequence
  Description of Artificial Sequence: Synthetic peptide
  Seed: RRCPHRERC (TP53 H179R)
RTCPHRERV

SEQ ID NO: 18380 - protein, 9 aa, Artificial Sequence
  Description of Artificial Sequence: Synthetic peptide
  Seed: RRCPHRERC (TP53 H179R)
RTCPHRERY

SEQ ID NO: 18381 - protein, 9 aa, Artificial Sequence
  Description of Artificial Sequence: Synthetic peptide
  Seed: RRCPHRERC (TP53 H179R)
RVCPHRERF

SEQ ID NO: 18382 - protein, 9 aa, Artificial Sequence
  Description of Artificial Sequence: Synthetic peptide
  Seed: RRCPHRERC (TP53 H179R)
RVCPHRERI

SEQ ID NO: 18383 - protein, 9 aa, Artificial Sequence
  Description of Artificial Sequence: Synthetic peptide
  Seed: RRCPHRERC (TP53 H179R)
RVCPHRERL

SEQ ID NO: 18384 - protein, 9 aa, Artificial Sequence
  Description of Artificial Sequence: Synthetic peptide
  Seed: RRCPHRERC (TP53 H179R)
RVCPHRERM

SEQ ID NO: 18385 - protein, 9 aa, Artificial Sequence
  Description of Artificial Sequence: Synthetic peptide
  Seed: RRCPHRERC (TP53 H179R)
RVCPHRERV

SEQ ID NO: 18386 - protein, 9 aa, Artificial Sequence
  Description of Artificial Sequence: Synthetic peptide
  Seed: RRCPHRERC (TP53 H179R)
RVCPHRERY

SEQ ID NO: 18387 - protein, 9 aa, Artificial Sequence
  Description of Artificial Sequence: Synthetic peptide
  Seed: RRCPHRERC (TP53 H179R)
RWCPHRERF

SEQ ID NO: 18388 - protein, 9 aa, Artificial Sequence
  Description of Artificial Sequence: Synthetic peptide
  Seed: RRCPHRERC (TP53 H179R)
RWCPHRERL

SEQ ID NO: 18389 - protein, 9 aa, Artificial Sequence
  Description of Artificial Sequence: Synthetic peptide
  Seed: RRCPHRERC (TP53 H179R)
RWCPHRERM

SEQ ID NO: 18390 - protein, 9 aa, Artificial Sequence
  Description of Artificial Sequence: Synthetic peptide
  Seed: RRCPHRERC (TP53 H179R)
RWCPHRERY

SEQ ID NO: 18391 - protein, 9 aa, Artificial Sequence
  Description of Artificial Sequence: Synthetic peptide
  Seed: RRCPHRERC (TP53 H179R)
RYCPHRERF

SEQ ID NO: 18392 - protein, 9 aa, Artificial Sequence
  Description of Artificial Sequence: Synthetic peptide
  Seed: RRCPHRERC (TP53 H179R)
RYCPHRERI

SEQ ID NO: 18393 - protein, 9 aa, Artificial Sequence
  Description of Artificial Sequence: Synthetic peptide
  Seed: RRCPHRERC (TP53 H179R)
RYCPHRERL

SEQ ID NO: 18394 - protein, 9 aa, Artificial Sequence
  Description of Artificial Sequence: Synthetic peptide
  Seed: RRCPHRERC (TP53 H179R)
RYCPHRERM

SEQ ID NO: 18395 - protein, 9 aa, Artificial Sequence
  Description of Artificial Sequence: Synthetic peptide
  Seed: RRCPHRERC (TP53 H179R)
RYCPHRERV

SEQ ID NO: 18396 - protein, 9 aa, Artificial Sequence
  Description of Artificial Sequence: Synthetic peptide
  Seed: RRCPHRERC (TP53 H179R)
RYCPHRERY

SEQ ID NO: 18397 - protein, 9 aa, Artificial Sequence
  Description of Artificial Sequence: Synthetic peptide
  Seed: VRRCPHRER (TP53 H179R)
VGRCPHREL

SEQ ID NO: 18398 - protein, 9 aa, Artificial Sequence
  Description of Artificial Sequence: Synthetic peptide
  Seed: VRRCPHRER (TP53 H179R)
VQRCPHREL

SEQ ID NO: 18399 - protein, 9 aa, Artificial Sequence
  Description of Artificial Sequence: Synthetic peptide
  Seed: VRRCPHRER (TP53 H179R)
VRRCPHREF

SEQ ID NO: 18400 - protein, 9 aa, Artificial Sequence
  Description of Artificial Sequence: Synthetic peptide
  Seed: VRRCPHRER (TP53 H179R)
VRRCPHREI

SEQ ID NO: 18401 - protein, 9 aa, Artificial Sequence
  Description of Artificial Sequence: Synthetic peptide
  Seed: VRRCPHRER (TP53 H179R)
VRRCPHREK

SEQ ID NO: 18402 - protein, 9 aa, Artificial Sequence
  Description of Artificial Sequence: Synthetic peptide
  Seed: VRRCPHRER (TP53 H179R)
VRRCPHREL

SEQ ID NO: 18403 - protein, 9 aa, Artificial Sequence
  Description of Artificial Sequence: Synthetic peptide
  Seed: VRRCPHRER (TP53 H179R)
VRRCPHREM

SEQ ID NO: 18404 - protein, 9 aa, Artificial Sequence
  Description of Artificial Sequence: Synthetic peptide
  Seed: VRRCPHRER (TP53 H179R)
VRRCPHREV

SEQ ID NO: 18405 - protein, 9 aa, Artificial Sequence
  Description of Artificial Sequence: Synthetic peptide
  Seed: VRRCPHRER (TP53 H179R)
VRRCPHREY

SEQ ID NO: 18406 - protein, 10 aa, Artificial Sequence
  Description of Artificial Sequence: Synthetic peptide
  Seed: VVRRCPHRER (TP53 H179R)
VVRRCPHREK

SEQ ID NO: 18407 - protein, 11 aa, Homo sapiens
  Native (TP53 H179R)
EVVRRCPHRER

SEQ ID NO: 18408 - protein, 10 aa, Homo sapiens
  Native (TP53 H179R)
RERCSDSDGL

SEQ ID NO: 18409 - protein, 11 aa, Homo sapiens
  Native (TP53 H179R)
RERCSDSDGLA

SEQ ID NO: 18410 - protein, 10 aa, Homo sapiens
  Native (TP53 H179R)
VVRRCPHRER

SEQ ID NO: 18411 - protein, 8 aa, Homo sapiens
  Native (TP53 H179R)
RRCPHRER

SEQ ID NO: 18412 - protein, 9 aa, Homo sapiens
  Native (TP53 H179R)
RRCPHRERC

SEQ ID NO: 18413 - protein, 9 aa, Homo sapiens
  Native (TP53 H179R)
VRRCPHRER

SEQ ID NO: 18414 - protein, 9 aa, Artificial Sequence
  Description of Artificial Sequence: Synthetic peptide
  Seed: GTRVLAMAI (TP53 R158L)
GARVLAMAA

SEQ ID NO: 18415 - protein, 9 aa, Artificial Sequence
  Description of Artificial Sequence: Synthetic peptide
  Seed: GTRVLAMAI (TP53 R158L)
GARVLAMAF

SEQ ID NO: 18416 - protein, 9 aa, Artificial Sequence
  Description of Artificial Sequence: Synthetic peptide
  Seed: GTRVLAMAI (TP53 R158L)
GARVLAMAI

SEQ ID NO: 18417 - protein, 10 aa, Artificial Sequence
  Description of Artificial Sequence: Synthetic peptide
  Seed: GTRVLAMAIY (TP53 R158L)
GARVLAMAIA

SEQ ID NO: 18418 - protein, 10 aa, Artificial Sequence
  Description of Artificial Sequence: Synthetic peptide
  Seed: GTRVLAMAIY (TP53 R158L)
GARVLAMAIF

SEQ ID NO: 18419 - protein, 10 aa, Artificial Sequence
  Description of Artificial Sequence: Synthetic peptide
  Seed: GTRVLAMAIY (TP53 R158L)
GARVLAMAIK

SEQ ID NO: 18420 - protein, 10 aa, Artificial Sequence
  Description of Artificial Sequence: Synthetic peptide
  Seed: GTRVLAMAIY (TP53 R158L)
GARVLAMAIW

SEQ ID NO: 18421 - protein, 10 aa, Artificial Sequence
  Description of Artificial Sequence: Synthetic peptide
  Seed: GTRVLAMAIY (TP53 R158L)
GARVLAMAIY

SEQ ID NO: 18422 - protein, 11 aa, Artificial Sequence
  Description of Artificial Sequence: Synthetic peptide
  Seed: GTRVLAMAIYK (TP53 R158L)
GARVLAMAIYK

SEQ ID NO: 18423 - protein, 11 aa, Artificial Sequence
  Description of Artificial Sequence: Synthetic peptide
  Seed: GTRVLAMAIYK (TP53 R158L)
GARVLAMAIYR

SEQ ID NO: 18424 - protein, 9 aa, Artificial Sequence
  Description of Artificial Sequence: Synthetic peptide
  Seed: GTRVLAMAI (TP53 R158L)
GARVLAMAK

SEQ ID NO: 18425 - protein, 9 aa, Artificial Sequence
  Description of Artificial Sequence: Synthetic peptide
  Seed: GTRVLAMAI (TP53 R158L)
GARVLAMAL

SEQ ID NO: 18426 - protein, 9 aa, Artificial Sequence
  Description of Artificial Sequence: Synthetic peptide
  Seed: GTRVLAMAI (TP53 R158L)
GARVLAMAM

SEQ ID NO: 18427 - protein, 9 aa, Artificial Sequence
  Description of Artificial Sequence: Synthetic peptide
  Seed: GTRVLAMAI (TP53 R158L)
GARVLAMAR

SEQ ID NO: 18428 - protein, 9 aa, Artificial Sequence
  Description of Artificial Sequence: Synthetic peptide
  Seed: GTRVLAMAI (TP53 R158L)
GARVLAMAS

SEQ ID NO: 18429 - protein, 9 aa, Artificial Sequence
  Description of Artificial Sequence: Synthetic peptide
  Seed: GTRVLAMAI (TP53 R158L)
GARVLAMAV

SEQ ID NO: 18430 - protein, 9 aa, Artificial Sequence
  Description of Artificial Sequence: Synthetic peptide
  Seed: GTRVLAMAI (TP53 R158L)
GARVLAMAW

SEQ ID NO: 18431 - protein, 9 aa, Artificial Sequence
  Description of Artificial Sequence: Synthetic peptide
  Seed: GTRVLAMAI (TP53 R158L)
GARVLAMAY

SEQ ID NO: 18432 - protein, 11 aa, Artificial Sequence
  Description of Artificial Sequence: Synthetic peptide
  Seed: GTRVLAMAIYK (TP53 R158L)
GCRVLAMAIYK

SEQ ID NO: 18433 - protein, 11 aa, Artificial Sequence
  Description of Artificial Sequence: Synthetic peptide
  Seed: GTRVLAMAIYK (TP53 R158L)
GCRVLAMAIYR

SEQ ID NO: 18434 - protein, 9 aa, Artificial Sequence
  Description of Artificial Sequence: Synthetic peptide
  Seed: GTRVLAMAI (TP53 R158L)
GCRVLAMAK

SEQ ID NO: 18435 - protein, 11 aa, Artificial Sequence
  Description of Artificial Sequence: Synthetic peptide
  Seed: GTRVLAMAIYK (TP53 R158L)
GDRVLAMAIYK

SEQ ID NO: 18436 - protein, 11 aa, Artificial Sequence
  Description of Artificial Sequence: Synthetic peptide
  Seed: GTRVLAMAIYK (TP53 R158L)
GDRVLAMAIYR

SEQ ID NO: 18437 - protein, 11 aa, Artificial Sequence
  Description of Artificial Sequence: Synthetic peptide
  Seed: GTRVLAMAIYK (TP53 R158L)
GERVLAMAIYK

SEQ ID NO: 18438 - protein, 11 aa, Artificial Sequence
  Description of Artificial Sequence: Synthetic peptide
  Seed: GTRVLAMAIYK (TP53 R158L)
GERVLAMAIYR

SEQ ID NO: 18439 - protein, 9 aa, Artificial Sequence
  Description of Artificial Sequence: Synthetic peptide
  Seed: GTRVLAMAI (TP53 R158L)
GFRVLAMAA

SEQ ID NO: 18440 - protein, 9 aa, Artificial Sequence
  Description of Artificial Sequence: Synthetic peptide
  Seed: GTRVLAMAI (TP53 R158L)
GFRVLAMAI

SEQ ID NO: 18441 - protein, 10 aa, Artificial Sequence
  Description of Artificial Sequence: Synthetic peptide
  Seed: GTRVLAMAIY (TP53 R158L)
GFRVLAMAIK

SEQ ID NO: 18442 - protein, 10 aa, Artificial Sequence
  Description of Artificial Sequence: Synthetic peptide
  Seed: GTRVLAMAIY (TP53 R158L)
GFRVLAMAIY

SEQ ID NO: 18443 - protein, 11 aa, Artificial Sequence
  Description of Artificial Sequence: Synthetic peptide
  Seed: GTRVLAMAIYK (TP53 R158L)
GFRVLAMAIYK

SEQ ID NO: 18444 - protein, 11 aa, Artificial Sequence
  Description of Artificial Sequence: Synthetic peptide
  Seed: GTRVLAMAIYK (TP53 R158L)
GFRVLAMAIYR

SEQ ID NO: 18445 - protein, 9 aa, Artificial Sequence
  Description of Artificial Sequence: Synthetic peptide
  Seed: GTRVLAMAI (TP53 R158L)
GFRVLAMAK

SEQ ID NO: 18446 - protein, 9 aa, Artificial Sequence
  Description of Artificial Sequence: Synthetic peptide
  Seed: GTRVLAMAI (TP53 R158L)
GFRVLAMAV

SEQ ID NO: 18447 - protein, 9 aa, Artificial Sequence
  Description of Artificial Sequence: Synthetic peptide
  Seed: GTRVLAMAI (TP53 R158L)
GGRVLAMAA

SEQ ID NO: 18448 - protein, 10 aa, Artificial Sequence
  Description of Artificial Sequence: Synthetic peptide
  Seed: GTRVLAMAIY (TP53 R158L)
GGRVLAMAIK

SEQ ID NO: 18449 - protein, 10 aa, Artificial Sequence
  Description of Artificial Sequence: Synthetic peptide
  Seed: GTRVLAMAIY (TP53 R158L)
GGRVLAMAIY

SEQ ID NO: 18450 - protein, 11 aa, Artificial Sequence
  Description of Artificial Sequence: Synthetic peptide
  Seed: GTRVLAMAIYK (TP53 R158L)
GGRVLAMAIYK

SEQ ID NO: 18451 - protein, 11 aa, Artificial Sequence
  Description of Artificial Sequence: Synthetic peptide
  Seed: GTRVLAMAIYK (TP53 R158L)
GGRVLAMAIYR

SEQ ID NO: 18452 - protein, 9 aa, Artificial Sequence
  Description of Artificial Sequence: Synthetic peptide
  Seed: GTRVLAMAI (TP53 R158L)
GGRVLAMAK

SEQ ID NO: 18453 - protein, 9 aa, Artificial Sequence
  Description of Artificial Sequence: Synthetic peptide
  Seed: GTRVLAMAI (TP53 R158L)
GGRVLAMAV

SEQ ID NO: 18454 - protein, 11 aa, Artificial Sequence
  Description of Artificial Sequence: Synthetic peptide
  Seed: GTRVLAMAIYK (TP53 R158L)
GHRVLAMAIYK

SEQ ID NO: 18455 - protein, 11 aa, Artificial Sequence
  Description of Artificial Sequence: Synthetic peptide
  Seed: GTRVLAMAIYK (TP53 R158L)
GHRVLAMAIYR

SEQ ID NO: 18456 - protein, 9 aa, Artificial Sequence
  Description of Artificial Sequence: Synthetic peptide
  Seed: GTRVLAMAI (TP53 R158L)
GHRVLAMAK

SEQ ID NO: 18457 - protein, 9 aa, Artificial Sequence
  Description of Artificial Sequence: Synthetic peptide
  Seed: GTRVLAMAI (TP53 R158L)
GIRVLAMAA

SEQ ID NO: 18458 - protein, 9 aa, Artificial Sequence
  Description of Artificial Sequence: Synthetic peptide
  Seed: GTRVLAMAI (TP53 R158L)
GIRVLAMAI

SEQ ID NO: 18459 - protein, 10 aa, Artificial Sequence
  Description of Artificial Sequence: Synthetic peptide
  Seed: GTRVLAMAIY (TP53 R158L)
GIRVLAMAIF

SEQ ID NO: 18460 - protein, 10 aa, Artificial Sequence
  Description of Artificial Sequence: Synthetic peptide
  Seed: GTRVLAMAIY (TP53 R158L)
GIRVLAMAIK

SEQ ID NO: 18461 - protein, 10 aa, Artificial Sequence
  Description of Artificial Sequence: Synthetic peptide
  Seed: GTRVLAMAIY (TP53 R158L)
GIRVLAMAIY

SEQ ID NO: 18462 - protein, 11 aa, Artificial Sequence
  Description of Artificial Sequence: Synthetic peptide
  Seed: GTRVLAMAIYK (TP53 R158L)
GIRVLAMAIYK

SEQ ID NO: 18463 - protein, 11 aa, Artificial Sequence
  Description of Artificial Sequence: Synthetic peptide
  Seed: GTRVLAMAIYK (TP53 R158L)
GIRVLAMAIYR

SEQ ID NO: 18464 - protein, 9 aa, Artificial Sequence
  Description of Artificial Sequence: Synthetic peptide
  Seed: GTRVLAMAI (TP53 R158L)
GIRVLAMAK

SEQ ID NO: 18465 - protein, 9 aa, Artificial Sequence
  Description of Artificial Sequence: Synthetic peptide
  Seed: GTRVLAMAI (TP53 R158L)
GIRVLAMAL

SEQ ID NO: 18466 - protein, 9 aa, Artificial Sequence
  Description of Artificial Sequence: Synthetic peptide
  Seed: GTRVLAMAI (TP53 R158L)
GIRVLAMAM

SEQ ID NO: 18467 - protein, 9 aa, Artificial Sequence
  Description of Artificial Sequence: Synthetic peptide
  Seed: GTRVLAMAI (TP53 R158L)
GIRVLAMAV

SEQ ID NO: 18468 - protein, 9 aa, Artificial Sequence
  Description of Artificial Sequence: Synthetic peptide
  Seed: GTRVLAMAI (TP53 R158L)
GIRVLAMAY

SEQ ID NO: 18469 - protein, 11 aa, Artificial Sequence
  Description of Artificial Sequence: Synthetic peptide
  Seed: GTRVLAMAIYK (TP53 R158L)
GKRVLAMAIYK

SEQ ID NO: 18470 - protein, 11 aa, Artificial Sequence
  Description of Artificial Sequence: Synthetic peptide
  Seed: GTRVLAMAIYK (TP53 R158L)
GKRVLAMAIYR

SEQ ID NO: 18471 - protein, 10 aa, Artificial Sequence
  Description of Artificial Sequence: Synthetic peptide
  Seed: GTRVLAMAIY (TP53 R158L)
GLRVLAMAIF

SEQ ID NO: 18472 - protein, 10 aa, Artificial Sequence
  Description of Artificial Sequence: Synthetic peptide
  Seed: GTRVLAMAIY (TP53 R158L)
GLRVLAMAIK

SEQ ID NO: 18473 - protein, 10 aa, Artificial Sequence
  Description of Artificial Sequence: Synthetic peptide
  Seed: GTRVLAMAIY (TP53 R158L)
GLRVLAMAIY

SEQ ID NO: 18474 - protein, 11 aa, Artificial Sequence
  Description of Artificial Sequence: Synthetic peptide
  Seed: GTRVLAMAIYK (TP53 R158L)
GLRVLAMAIYK

SEQ ID NO: 18475 - protein, 11 aa, Artificial Sequence
  Description of Artificial Sequence: Synthetic peptide
  Seed: GTRVLAMAIYK (TP53 R158L)
GLRVLAMAIYR

SEQ ID NO: 18476 - protein, 9 aa, Artificial Sequence
  Description of Artificial Sequence: Synthetic peptide
  Seed: GTRVLAMAI (TP53 R158L)
GLRVLAMAK

SEQ ID NO: 18477 - protein, 9 aa, Artificial Sequence
  Description of Artificial Sequence: Synthetic peptide
  Seed: GTRVLAMAI (TP53 R158L)
GMRVLAMAA

SEQ ID NO: 18478 - protein, 9 aa, Artificial Sequence
  Description of Artificial Sequence: Synthetic peptide
  Seed: GTRVLAMAI (TP53 R158L)
GMRVLAMAI

SEQ ID NO: 18479 - protein, 10 aa, Artificial Sequence
  Description of Artificial Sequence: Synthetic peptide
  Seed: GTRVLAMAIY (TP53 R158L)
GMRVLAMAIF

SEQ ID NO: 18480 - protein, 10 aa, Artificial Sequence
  Description of Artificial Sequence: Synthetic peptide
  Seed: GTRVLAMAIY (TP53 R158L)
GMRVLAMAIK

SEQ ID NO: 18481 - protein, 10 aa, Artificial Sequence
  Description of Artificial Sequence: Synthetic peptide
  Seed: GTRVLAMAIY (TP53 R158L)
GMRVLAMAIM

SEQ ID NO: 18482 - protein, 11 aa, Artificial Sequence
  Description of Artificial Sequence: Synthetic peptide
  Seed: GTRVLAMAIYK (TP53 R158L)
GMRVLAMAIYK

SEQ ID NO: 18483 - protein, 11 aa, Artificial Sequence
  Description of Artificial Sequence: Synthetic peptide
  Seed: GTRVLAMAIYK (TP53 R158L)
GMRVLAMAIYR

SEQ ID NO: 18484 - protein, 9 aa, Artificial Sequence
  Description of Artificial Sequence: Synthetic peptide
  Seed: GTRVLAMAI (TP53 R158L)
GMRVLAMAK

SEQ ID NO: 18485 - protein, 9 aa, Artificial Sequence
  Description of Artificial Sequence: Synthetic peptide
  Seed: GTRVLAMAI (TP53 R158L)
GMRVLAMAL

SEQ ID NO: 18486 - protein, 9 aa, Artificial Sequence
  Description of Artificial Sequence: Synthetic peptide
  Seed: GTRVLAMAI (TP53 R158L)
GMRVLAMAM

SEQ ID NO: 18487 - protein, 9 aa, Artificial Sequence
  Description of Artificial Sequence: Synthetic peptide
  Seed: GTRVLAMAI (TP53 R158L)
GMRVLAMAR

SEQ ID NO: 18488 - protein, 9 aa, Artificial Sequence
  Description of Artificial Sequence: Synthetic peptide
  Seed: GTRVLAMAI (TP53 R158L)
GMRVLAMAV

SEQ ID NO: 18489 - protein, 9 aa, Artificial Sequence
  Description of Artificial Sequence: Synthetic peptide
  Seed: GTRVLAMAI (TP53 R158L)
GMRVLAMAY

SEQ ID NO: 18490 - protein, 9 aa, Artificial Sequence
  Description of Artificial Sequence: Synthetic peptide
  Seed: GTRVLAMAI (TP53 R158L)
GNRVLAMAA

SEQ ID NO: 18491 - protein, 10 aa, Artificial Sequence
  Description of Artificial Sequence: Synthetic peptide
  Seed: GTRVLAMAIY (TP53 R158L)
GNRVLAMAIK

SEQ ID NO: 18492 - protein, 10 aa, Artificial Sequence
  Description of Artificial Sequence: Synthetic peptide
  Seed: GTRVLAMAIY (TP53 R158L)
GNRVLAMAIY

SEQ ID NO: 18493 - protein, 11 aa, Artificial Sequence
  Description of Artificial Sequence: Synthetic peptide
  Seed: GTRVLAMAIYK (TP53 R158L)
GNRVLAMAIYK

SEQ ID NO: 18494 - protein, 11 aa, Artificial Sequence
  Description of Artificial Sequence: Synthetic peptide
  Seed: GTRVLAMAIYK (TP53 R158L)
GNRVLAMAIYR

SEQ ID NO: 18495 - protein, 9 aa, Artificial Sequence
  Description of Artificial Sequence: Synthetic peptide
  Seed: GTRVLAMAI (TP53 R158L)
GNRVLAMAK

SEQ ID NO: 18496 - protein, 11 aa, Artificial Sequence
  Description of Artificial Sequence: Synthetic peptide
  Seed: GTRVLAMAIYK (TP53 R158L)
GPRVLAMAIYK

SEQ ID NO: 18497 - protein, 11 aa, Artificial Sequence
  Description of Artificial Sequence: Synthetic peptide
  Seed: GTRVLAMAIYK (TP53 R158L)
GPRVLAMAIYR

SEQ ID NO: 18498 - protein, 9 aa, Artificial Sequence
  Description of Artificial Sequence: Synthetic peptide
  Seed: GTRVLAMAI (TP53 R158L)
GQRVLAMAA

SEQ ID NO: 18499 - protein, 9 aa, Artificial Sequence
  Description of Artificial Sequence: Synthetic peptide
  Seed: GTRVLAMAI (TP53 R158L)
GQRVLAMAI

SEQ ID NO: 18500 - protein, 10 aa, Artificial Sequence
  Description of Artificial Sequence: Synthetic peptide
  Seed: GTRVLAMAIY (TP53 R158L)
GQRVLAMAIF

SEQ ID NO: 18501 - protein, 10 aa, Artificial Sequence
  Description of Artificial Sequence: Synthetic peptide
  Seed: GTRVLAMAIY (TP53 R158L)
GQRVLAMAIK

SEQ ID NO: 18502 - protein, 10 aa, Artificial Sequence
  Description of Artificial Sequence: Synthetic peptide
  Seed: GTRVLAMAIY (TP53 R158L)
GQRVLAMAIL

SEQ ID NO: 18503 - protein, 10 aa, Artificial Sequence
  Description of Artificial Sequence: Synthetic peptide
  Seed: GTRVLAMAIY (TP53 R158L)
GQRVLAMAIM

SEQ ID NO: 18504 - protein, 11 aa, Artificial Sequence
  Description of Artificial Sequence: Synthetic peptide
  Seed: GTRVLAMAIYK (TP53 R158L)
GQRVLAMAIYK

SEQ ID NO: 18505 - protein, 11 aa, Artificial Sequence
  Description of Artificial Sequence: Synthetic peptide
  Seed: GTRVLAMAIYK (TP53 R158L)
GQRVLAMAIYR

SEQ ID NO: 18506 - protein, 9 aa, Artificial Sequence
  Description of Artificial Sequence: Synthetic peptide
  Seed: GTRVLAMAI (TP53 R158L)
GQRVLAMAK

SEQ ID NO: 18507 - protein, 9 aa, Artificial Sequence
  Description of Artificial Sequence: Synthetic peptide
  Seed: GTRVLAMAI (TP53 R158L)
GQRVLAMAV

SEQ ID NO: 18508 - protein, 11 aa, Artificial Sequence
  Description of Artificial Sequence: Synthetic peptide
  Seed: GTRVLAMAIYK (TP53 R158L)
GRRVLAMAIYK

SEQ ID NO: 18509 - protein, 11 aa, Artificial Sequence
  Description of Artificial Sequence: Synthetic peptide
  Seed: GTRVLAMAIYK (TP53 R158L)
GRRVLAMAIYR

SEQ ID NO: 18510 - protein, 9 aa, Artificial Sequence
  Description of Artificial Sequence: Synthetic peptide
  Seed: GTRVLAMAI (TP53 R158L)
GSRVLAMAA

SEQ ID NO: 18511 - protein, 9 aa, Artificial Sequence
  Description of Artificial Sequence: Synthetic peptide
  Seed: GTRVLAMAI (TP53 R158L)
GSRVLAMAC

SEQ ID NO: 18512 - protein, 9 aa, Artificial Sequence
  Description of Artificial Sequence: Synthetic peptide
  Seed: GTRVLAMAI (TP53 R158L)
GSRVLAMAF

SEQ ID NO: 18513 - protein, 9 aa, Artificial Sequence
  Description of Artificial Sequence: Synthetic peptide
  Seed: GTRVLAMAI (TP53 R158L)
GSRVLAMAG

SEQ ID NO: 18514 - protein, 9 aa, Artificial Sequence
  Description of Artificial Sequence: Synthetic peptide
  Seed: GTRVLAMAI (TP53 R158L)
GSRVLAMAH

SEQ ID NO: 18515 - protein, 9 aa, Artificial Sequence
  Description of Artificial Sequence: Synthetic peptide
  Seed: GTRVLAMAI (TP53 R158L)
GSRVLAMAI

SEQ ID NO: 18516 - protein, 10 aa, Artificial Sequence
  Description of Artificial Sequence: Synthetic peptide
  Seed: GTRVLAMAIY (TP53 R158L)
GSRVLAMAIA

SEQ ID NO: 18517 - protein, 10 aa, Artificial Sequence
  Description of Artificial Sequence: Synthetic peptide
  Seed: GTRVLAMAIY (TP53 R158L)
GSRVLAMAIF

SEQ ID NO: 18518 - protein, 10 aa, Artificial Sequence
  Description of Artificial Sequence: Synthetic peptide
  Seed: GTRVLAMAIY (TP53 R158L)
GSRVLAMAII

SEQ ID NO: 18519 - protein, 10 aa, Artificial Sequence
  Description of Artificial Sequence: Synthetic peptide
  Seed: GTRVLAMAIY (TP53 R158L)
GSRVLAMAIK

SEQ ID NO: 18520 - protein, 10 aa, Artificial Sequence
  Description of Artificial Sequence: Synthetic peptide
  Seed: GTRVLAMAIY (TP53 R158L)
GSRVLAMAIL

SEQ ID NO: 18521 - protein, 10 aa, Artificial Sequence
  Description of Artificial Sequence: Synthetic peptide
  Seed: GTRVLAMAIY (TP53 R158L)
GSRVLAMAIM

SEQ ID NO: 18522 - protein, 10 aa, Artificial Sequence
  Description of Artificial Sequence: Synthetic peptide
  Seed: GTRVLAMAIY (TP53 R158L)
GSRVLAMAIS

SEQ ID NO: 18523 - protein, 10 aa, Artificial Sequence
  Description of Artificial Sequence: Synthetic peptide
  Seed: GTRVLAMAIY (TP53 R158L)
GSRVLAMAIV

SEQ ID NO: 18524 - protein, 10 aa, Artificial Sequence
  Description of Artificial Sequence: Synthetic peptide
  Seed: GTRVLAMAIY (TP53 R158L)
GSRVLAMAIW

SEQ ID NO: 18525 - protein, 10 aa, Artificial Sequence
  Description of Artificial Sequence: Synthetic peptide
  Seed: GTRVLAMAIY (TP53 R158L)
GSRVLAMAIY

SEQ ID NO: 18526 - protein, 11 aa, Artificial Sequence
  Description of Artificial Sequence: Synthetic peptide
  Seed: GTRVLAMAIYK (TP53 R158L)
GSRVLAMAIYA

SEQ ID NO: 18527 - protein, 11 aa, Artificial Sequence
  Description of Artificial Sequence: Synthetic peptide
  Seed: GTRVLAMAIYK (TP53 R158L)
GSRVLAMAIYK

SEQ ID NO: 18528 - protein, 11 aa, Artificial Sequence
  Description of Artificial Sequence: Synthetic peptide
  Seed: GTRVLAMAIYK (TP53 R158L)
GSRVLAMAIYR

SEQ ID NO: 18529 - protein, 9 aa, Artificial Sequence
  Description of Artificial Sequence: Synthetic peptide
  Seed: GTRVLAMAI (TP53 R158L)
GSRVLAMAK

SEQ ID NO: 18530 - protein, 9 aa, Artificial Sequence
  Description of Artificial Sequence: Synthetic peptide
  Seed: GTRVLAMAI (TP53 R158L)
GSRVLAMAL

SEQ ID NO: 18531 - protein, 9 aa, Artificial Sequence
  Description of Artificial Sequence: Synthetic peptide
  Seed: GTRVLAMAI (TP53 R158L)
GSRVLAMAM

SEQ ID NO: 18532 - protein, 9 aa, Artificial Sequence
  Description of Artificial Sequence: Synthetic peptide
  Seed: GTRVLAMAI (TP53 R158L)
GSRVLAMAN

SEQ ID NO: 18533 - protein, 9 aa, Artificial Sequence
  Description of Artificial Sequence: Synthetic peptide
  Seed: GTRVLAMAI (TP53 R158L)
GSRVLAMAP

SEQ ID NO: 18534 - protein, 9 aa, Artificial Sequence
  Description of Artificial Sequence: Synthetic peptide
  Seed: GTRVLAMAI (TP53 R158L)
GSRVLAMAQ

SEQ ID NO: 18535 - protein, 9 aa, Artificial Sequence
  Description of Artificial Sequence: Synthetic peptide
  Seed: GTRVLAMAI (TP53 R158L)
GSRVLAMAR

SEQ ID NO: 18536 - protein, 9 aa, Artificial Sequence
  Description of Artificial Sequence: Synthetic peptide
  Seed: GTRVLAMAI (TP53 R158L)
GSRVLAMAS

SEQ ID NO: 18537 - protein, 9 aa, Artificial Sequence
  Description of Artificial Sequence: Synthetic peptide
  Seed: GTRVLAMAI (TP53 R158L)
GSRVLAMAT

SEQ ID NO: 18538 - protein, 9 aa, Artificial Sequence
  Description of Artificial Sequence: Synthetic peptide
  Seed: GTRVLAMAI (TP53 R158L)
GSRVLAMAV

SEQ ID NO: 18539 - protein, 9 aa, Artificial Sequence
  Description of Artificial Sequence: Synthetic peptide
  Seed: GTRVLAMAI (TP53 R158L)
GSRVLAMAW

SEQ ID NO: 18540 - protein, 9 aa, Artificial Sequence
  Description of Artificial Sequence: Synthetic peptide
  Seed: GTRVLAMAI (TP53 R158L)
GSRVLAMAY

SEQ ID NO: 18541 - protein, 9 aa, Artificial Sequence
  Description of Artificial Sequence: Synthetic peptide
  Seed: GTRVLAMAI (TP53 R158L)
GTRVLAMAA

SEQ ID NO: 18542 - protein, 9 aa, Artificial Sequence
  Description of Artificial Sequence: Synthetic peptide
  Seed: GTRVLAMAI (TP53 R158L)
GTRVLAMAC

SEQ ID NO: 18543 - protein, 9 aa, Artificial Sequence
  Description of Artificial Sequence: Synthetic peptide
  Seed: GTRVLAMAI (TP53 R158L)
GTRVLAMAF

SEQ ID NO: 18544 - protein, 9 aa, Artificial Sequence
  Description of Artificial Sequence: Synthetic peptide
  Seed: GTRVLAMAI (TP53 R158L)
GTRVLAMAG

SEQ ID NO: 18545 - protein, 9 aa, Artificial Sequence
  Description of Artificial Sequence: Synthetic peptide
  Seed: GTRVLAMAI (TP53 R158L)
GTRVLAMAH

SEQ ID NO: 18546 - protein, 10 aa, Artificial Sequence
  Description of Artificial Sequence: Synthetic peptide
  Seed: GTRVLAMAIY (TP53 R158L)
GTRVLAMAIA

SEQ ID NO: 18547 - protein, 10 aa, Artificial Sequence
  Description of Artificial Sequence: Synthetic peptide
  Seed: GTRVLAMAIY (TP53 R158L)
GTRVLAMAIF

SEQ ID NO: 18548 - protein, 10 aa, Artificial Sequence
  Description of Artificial Sequence: Synthetic peptide
  Seed: GTRVLAMAIY (TP53 R158L)
GTRVLAMAII

SEQ ID NO: 18549 - protein, 10 aa, Artificial Sequence
  Description of Artificial Sequence: Synthetic peptide
  Seed: GTRVLAMAIY (TP53 R158L)
GTRVLAMAIK

SEQ ID NO: 18550 - protein, 10 aa, Artificial Sequence
  Description of Artificial Sequence: Synthetic peptide
  Seed: GTRVLAMAIY (TP53 R158L)
GTRVLAMAIL

SEQ ID NO: 18551 - protein, 10 aa, Artificial Sequence
  Description of Artificial Sequence: Synthetic peptide
  Seed: GTRVLAMAIY (TP53 R158L)
GTRVLAMAIM

SEQ ID NO: 18552 - protein, 10 aa, Artificial Sequence
  Description of Artificial Sequence: Synthetic peptide
  Seed: GTRVLAMAIY (TP53 R158L)
GTRVLAMAIS

SEQ ID NO: 18553 - protein, 10 aa, Artificial Sequence
  Description of Artificial Sequence: Synthetic peptide
  Seed: GTRVLAMAIY (TP53 R158L)
GTRVLAMAIV

SEQ ID NO: 18554 - protein, 10 aa, Artificial Sequence
  Description of Artificial Sequence: Synthetic peptide
  Seed: GTRVLAMAIY (TP53 R158L)
GTRVLAMAIW

SEQ ID NO: 18555 - protein, 11 aa, Artificial Sequence
  Description of Artificial Sequence: Synthetic peptide
  Seed: GTRVLAMAIYK (TP53 R158L)
GTRVLAMAIYA

SEQ ID NO: 18556 - protein, 11 aa, Artificial Sequence
  Description of Artificial Sequence: Synthetic peptide
  Seed: GTRVLAMAIYK (TP53 R158L)
GTRVLAMAIYR

SEQ ID NO: 18557 - protein, 11 aa, Artificial Sequence
  Description of Artificial Sequence: Synthetic peptide
  Seed: GTRVLAMAIYK (TP53 R158L)
GTRVLAMAIYV

SEQ ID NO: 18558 - protein, 9 aa, Artificial Sequence
  Description of Artificial Sequence: Synthetic peptide
  Seed: GTRVLAMAI (TP53 R158L)
GTRVLAMAK

SEQ ID NO: 18559 - protein, 9 aa, Artificial Sequence
  Description of Artificial Sequence: Synthetic peptide
  Seed: GTRVLAMAI (TP53 R158L)
GTRVLAMAL

SEQ ID NO: 18560 - protein, 9 aa, Artificial Sequence
  Description of Artificial Sequence: Synthetic peptide
  Seed: GTRVLAMAI (TP53 R158L)
GTRVLAMAM

SEQ ID NO: 18561 - protein, 9 aa, Artificial Sequence
  Description of Artificial Sequence: Synthetic peptide
  Seed: GTRVLAMAI (TP53 R158L)
GTRVLAMAN

SEQ ID NO: 18562 - protein, 9 aa, Artificial Sequence
  Description of Artificial Sequence: Synthetic peptide
  Seed: GTRVLAMAI (TP53 R158L)
GTRVLAMAP

SEQ ID NO: 18563 - protein, 9 aa, Artificial Sequence
  Description of Artificial Sequence: Synthetic peptide
  Seed: GTRVLAMAI (TP53 R158L)
GTRVLAMAQ

SEQ ID NO: 18564 - protein, 9 aa, Artificial Sequence
  Description of Artificial Sequence: Synthetic peptide
  Seed: GTRVLAMAI (TP53 R158L)
GTRVLAMAR

SEQ ID NO: 18565 - protein, 9 aa, Artificial Sequence
  Description of Artificial Sequence: Synthetic peptide
  Seed: GTRVLAMAI (TP53 R158L)
GTRVLAMAS

SEQ ID NO: 18566 - protein, 9 aa, Artificial Sequence
  Description of Artificial Sequence: Synthetic peptide
  Seed: GTRVLAMAI (TP53 R158L)
GTRVLAMAT

SEQ ID NO: 18567 - protein, 9 aa, Artificial Sequence
  Description of Artificial Sequence: Synthetic peptide
  Seed: GTRVLAMAI (TP53 R158L)
GTRVLAMAV

SEQ ID NO: 18568 - protein, 9 aa, Artificial Sequence
  Description of Artificial Sequence: Synthetic peptide
  Seed: GTRVLAMAI (TP53 R158L)
GTRVLAMAW

SEQ ID NO: 18569 - protein, 9 aa, Artificial Sequence
  Description of Artificial Sequence: Synthetic peptide
  Seed: GTRVLAMAI (TP53 R158L)
GVRVLAMAA

SEQ ID NO: 18570 - protein, 9 aa, Artificial Sequence
  Description of Artificial Sequence: Synthetic peptide
  Seed: GTRVLAMAI (TP53 R158L)
GVRVLAMAG

SEQ ID NO: 18571 - protein, 9 aa, Artificial Sequence
  Description of Artificial Sequence: Synthetic peptide
  Seed: GTRVLAMAI (TP53 R158L)
GVRVLAMAI

SEQ ID NO: 18572 - protein, 10 aa, Artificial Sequence
  Description of Artificial Sequence: Synthetic peptide
  Seed: GTRVLAMAIY (TP53 R158L)
GVRVLAMAIA

SEQ ID NO: 18573 - protein, 10 aa, Artificial Sequence
  Description of Artificial Sequence: Synthetic peptide
  Seed: GTRVLAMAIY (TP53 R158L)
GVRVLAMAIF

SEQ ID NO: 18574 - protein, 10 aa, Artificial Sequence
  Description of Artificial Sequence: Synthetic peptide
  Seed: GTRVLAMAIY (TP53 R158L)
GVRVLAMAIK

SEQ ID NO: 18575 - protein, 10 aa, Artificial Sequence
  Description of Artificial Sequence: Synthetic peptide
  Seed: GTRVLAMAIY (TP53 R158L)
GVRVLAMAIY

SEQ ID NO: 18576 - protein, 11 aa, Artificial Sequence
  Description of Artificial Sequence: Synthetic peptide
  Seed: GTRVLAMAIYK (TP53 R158L)
GVRVLAMAIYK

SEQ ID NO: 18577 - protein, 11 aa, Artificial Sequence
  Description of Artificial Sequence: Synthetic peptide
  Seed: GTRVLAMAIYK (TP53 R158L)
GVRVLAMAIYR

SEQ ID NO: 18578 - protein, 9 aa, Artificial Sequence
  Description of Artificial Sequence: Synthetic peptide
  Seed: GTRVLAMAI (TP53 R158L)
GVRVLAMAK

SEQ ID NO: 18579 - protein, 9 aa, Artificial Sequence
  Description of Artificial Sequence: Synthetic peptide
  Seed: GTRVLAMAI (TP53 R158L)
GVRVLAMAL

SEQ ID NO: 18580 - protein, 9 aa, Artificial Sequence
  Description of Artificial Sequence: Synthetic peptide
  Seed: GTRVLAMAI (TP53 R158L)
GVRVLAMAM

SEQ ID NO: 18581 - protein, 9 aa, Artificial Sequence
  Description of Artificial Sequence: Synthetic peptide
  Seed: GTRVLAMAI (TP53 R158L)
GVRVLAMAR

SEQ ID NO: 18582 - protein, 9 aa, Artificial Sequence
  Description of Artificial Sequence: Synthetic peptide
  Seed: GTRVLAMAI (TP53 R158L)
GVRVLAMAS

SEQ ID NO: 18583 - protein, 9 aa, Artificial Sequence
  Description of Artificial Sequence: Synthetic peptide
  Seed: GTRVLAMAI (TP53 R158L)
GVRVLAMAV

SEQ ID NO: 18584 - protein, 9 aa, Artificial Sequence
  Description of Artificial Sequence: Synthetic peptide
  Seed: GTRVLAMAI (TP53 R158L)
GVRVLAMAW

SEQ ID NO: 18585 - protein, 9 aa, Artificial Sequence
  Description of Artificial Sequence: Synthetic peptide
  Seed: GTRVLAMAI (TP53 R158L)
GVRVLAMAY

SEQ ID NO: 18586 - protein, 9 aa, Artificial Sequence
  Description of Artificial Sequence: Synthetic peptide
  Seed: GTRVLAMAI (TP53 R158L)
GWRVLAMAA

SEQ ID NO: 18587 - protein, 9 aa, Artificial Sequence
  Description of Artificial Sequence: Synthetic peptide
  Seed: GTRVLAMAI (TP53 R158L)
GWRVLAMAI

SEQ ID NO: 18588 - protein, 10 aa, Artificial Sequence
  Description of Artificial Sequence: Synthetic peptide
  Seed: GTRVLAMAIY (TP53 R158L)
GWRVLAMAIK

SEQ ID NO: 18589 - protein, 10 aa, Artificial Sequence
  Description of Artificial Sequence: Synthetic peptide
  Seed: GTRVLAMAIY (TP53 R158L)
GWRVLAMAIY

SEQ ID NO: 18590 - protein, 11 aa, Artificial Sequence
  Description of Artificial Sequence: Synthetic peptide
  Seed: GTRVLAMAIYK (TP53 R158L)
GWRVLAMAIYK

SEQ ID NO: 18591 - protein, 11 aa, Artificial Sequence
  Description of Artificial Sequence: Synthetic peptide
  Seed: GTRVLAMAIYK (TP53 R158L)
GWRVLAMAIYR

SEQ ID NO: 18592 - protein, 9 aa, Artificial Sequence
  Description of Artificial Sequence: Synthetic peptide
  Seed: GTRVLAMAI (TP53 R158L)
GWRVLAMAK

SEQ ID NO: 18593 - protein, 9 aa, Artificial Sequence
  Description of Artificial Sequence: Synthetic peptide
  Seed: GTRVLAMAI (TP53 R158L)
GWRVLAMAV

SEQ ID NO: 18594 - protein, 9 aa, Artificial Sequence
  Description of Artificial Sequence: Synthetic peptide
  Seed: GTRVLAMAI (TP53 R158L)
GYRVLAMAA

SEQ ID NO: 18595 - protein, 9 aa, Artificial Sequence
  Description of Artificial Sequence: Synthetic peptide
  Seed: GTRVLAMAI (TP53 R158L)
GYRVLAMAI

SEQ ID NO: 18596 - protein, 10 aa, Artificial Sequence
  Description of Artificial Sequence: Synthetic peptide
  Seed: GTRVLAMAIY (TP53 R158L)
GYRVLAMAIA

SEQ ID NO: 18597 - protein, 10 aa, Artificial Sequence
  Description of Artificial Sequence: Synthetic peptide
  Seed: GTRVLAMAIY (TP53 R158L)
GYRVLAMAIK

SEQ ID NO: 18598 - protein, 10 aa, Artificial Sequence
  Description of Artificial Sequence: Synthetic peptide
  Seed: GTRVLAMAIY (TP53 R158L)
GYRVLAMAIY

SEQ ID NO: 18599 - protein, 11 aa, Artificial Sequence
  Description of Artificial Sequence: Synthetic peptide
  Seed: GTRVLAMAIYK (TP53 R158L)
GYRVLAMAIYK

SEQ ID NO: 18600 - protein, 11 aa, Artificial Sequence
  Description of Artificial Sequence: Synthetic peptide
  Seed: GTRVLAMAIYK (TP53 R158L)
GYRVLAMAIYR

SEQ ID NO: 18601 - protein, 9 aa, Artificial Sequence
  Description of Artificial Sequence: Synthetic peptide
  Seed: GTRVLAMAI (TP53 R158L)
GYRVLAMAK

SEQ ID NO: 18602 - protein, 9 aa, Artificial Sequence
  Description of Artificial Sequence: Synthetic peptide
  Seed: GTRVLAMAI (TP53 R158L)
GYRVLAMAL

SEQ ID NO: 18603 - protein, 9 aa, Artificial Sequence
  Description of Artificial Sequence: Synthetic peptide
  Seed: GTRVLAMAI (TP53 R158L)
GYRVLAMAM

SEQ ID NO: 18604 - protein, 9 aa, Artificial Sequence
  Description of Artificial Sequence: Synthetic peptide
  Seed: GTRVLAMAI (TP53 R158L)
GYRVLAMAR

SEQ ID NO: 18605 - protein, 9 aa, Artificial Sequence
  Description of Artificial Sequence: Synthetic peptide
  Seed: GTRVLAMAI (TP53 R158L)
GYRVLAMAS

SEQ ID NO: 18606 - protein, 9 aa, Artificial Sequence
  Description of Artificial Sequence: Synthetic peptide
  Seed: GTRVLAMAI (TP53 R158L)
GYRVLAMAV

SEQ ID NO: 18607 - protein, 9 aa, Artificial Sequence
  Description of Artificial Sequence: Synthetic peptide
  Seed: PPGTRVLAM (TP53 R158L)
PPGTRVLAL

SEQ ID NO: 18608 - protein, 8 aa, Artificial Sequence
  Description of Artificial Sequence: Synthetic peptide
  Seed: RVLAMAIY (TP53 R158L)
RALAMAIF

SEQ ID NO: 18609 - protein, 8 aa, Artificial Sequence
  Description of Artificial Sequence: Synthetic peptide
  Seed: RVLAMAIY (TP53 R158L)
RALAMAIY

SEQ ID NO: 18610 - protein, 9 aa, Artificial Sequence
  Description of Artificial Sequence: Synthetic peptide
  Seed: RVLAMAIYK (TP53 R158L)
RALAMAIYA

SEQ ID NO: 18611 - protein, 9 aa, Artificial Sequence
  Description of Artificial Sequence: Synthetic peptide
  Seed: RVLAMAIYK (TP53 R158L)
RALAMAIYH

SEQ ID NO: 18612 - protein, 9 aa, Artificial Sequence
  Description of Artificial Sequence: Synthetic peptide
  Seed: RVLAMAIYK (TP53 R158L)
RALAMAIYI

SEQ ID NO: 18613 - protein, 9 aa, Artificial Sequence
  Description of Artificial Sequence: Synthetic peptide
  Seed: RVLAMAIYK (TP53 R158L)
RALAMAIYK

SEQ ID NO: 18614 - protein, 10 aa, Artificial Sequence
  Description of Artificial Sequence: Synthetic peptide
  Seed: RVLAMAIYKQ (TP53 R158L)
RALAMAIYKA

SEQ ID NO: 18615 - protein, 10 aa, Artificial Sequence
  Description of Artificial Sequence: Synthetic peptide
  Seed: RVLAMAIYKQ (TP53 R158L)
RALAMAIYKC

SEQ ID NO: 18616 - protein, 10 aa, Artificial Sequence
  Description of Artificial Sequence: Synthetic peptide
  Seed: RVLAMAIYKQ (TP53 R158L)
RALAMAIYKD

SEQ ID NO: 18617 - protein, 10 aa, Artificial Sequence
  Description of Artificial Sequence: Synthetic peptide
  Seed: RVLAMAIYKQ (TP53 R158L)
RALAMAIYKE

SEQ ID NO: 18618 - protein, 10 aa, Artificial Sequence
  Description of Artificial Sequence: Synthetic peptide
  Seed: RVLAMAIYKQ (TP53 R158L)
RALAMAIYKF

SEQ ID NO: 18619 - protein, 10 aa, Artificial Sequence
  Description of Artificial Sequence: Synthetic peptide
  Seed: RVLAMAIYKQ (TP53 R158L)
RALAMAIYKG

SEQ ID NO: 18620 - protein, 10 aa, Artificial Sequence
  Description of Artificial Sequence: Synthetic peptide
  Seed: RVLAMAIYKQ (TP53 R158L)
RALAMAIYKH

SEQ ID NO: 18621 - protein, 10 aa, Artificial Sequence
  Description of Artificial Sequence: Synthetic peptide
  Seed: RVLAMAIYKQ (TP53 R158L)
RALAMAIYKI

SEQ ID NO: 18622 - protein, 10 aa, Artificial Sequence
  Description of Artificial Sequence: Synthetic peptide
  Seed: RVLAMAIYKQ (TP53 R158L)
RALAMAIYKK

SEQ ID NO: 18623 - protein, 10 aa, Artificial Sequence
  Description of Artificial Sequence: Synthetic peptide
  Seed: RVLAMAIYKQ (TP53 R158L)
RALAMAIYKL

SEQ ID NO: 18624 - protein, 10 aa, Artificial Sequence
  Description of Artificial Sequence: Synthetic peptide
  Seed: RVLAMAIYKQ (TP53 R158L)
RALAMAIYKM

SEQ ID NO: 18625 - protein, 10 aa, Artificial Sequence
  Description of Artificial Sequence: Synthetic peptide
  Seed: RVLAMAIYKQ (TP53 R158L)
RALAMAIYKN

SEQ ID NO: 18626 - protein, 10 aa, Artificial Sequence
  Description of Artificial Sequence: Synthetic peptide
  Seed: RVLAMAIYKQ (TP53 R158L)
RALAMAIYKP

SEQ ID NO: 18627 - protein, 10 aa, Artificial Sequence
  Description of Artificial Sequence: Synthetic peptide
  Seed: RVLAMAIYKQ (TP53 R158L)
RALAMAIYKQ

SEQ ID NO: 18628 - protein, 10 aa, Artificial Sequence
  Description of Artificial Sequence: Synthetic peptide
  Seed: RVLAMAIYKQ (TP53 R158L)
RALAMAIYKR

SEQ ID NO: 18629 - protein, 10 aa, Artificial Sequence
  Description of Artificial Sequence: Synthetic peptide
  Seed: RVLAMAIYKQ (TP53 R158L)
RALAMAIYKS

SEQ ID NO: 18630 - protein, 10 aa, Artificial Sequence
  Description of Artificial Sequence: Synthetic peptide
  Seed: RVLAMAIYKQ (TP53 R158L)
RALAMAIYKT

SEQ ID NO: 18631 - protein, 10 aa, Artificial Sequence
  Description of Artificial Sequence: Synthetic peptide
  Seed: RVLAMAIYKQ (TP53 R158L)
RALAMAIYKV

SEQ ID NO: 18632 - protein, 10 aa, Artificial Sequence
  Description of Artificial Sequence: Synthetic peptide
  Seed: RVLAMAIYKQ (TP53 R158L)
RALAMAIYKW

SEQ ID NO: 18633 - protein, 10 aa, Artificial Sequence
  Description of Artificial Sequence: Synthetic peptide
  Seed: RVLAMAIYKQ (TP53 R158L)
RALAMAIYKY

SEQ ID NO: 18634 - protein, 9 aa, Artificial Sequence
  Description of Artificial Sequence: Synthetic peptide
  Seed: RVLAMAIYK (TP53 R158L)
RALAMAIYL

SEQ ID NO: 18635 - protein, 9 aa, Artificial Sequence
  Description of Artificial Sequence: Synthetic peptide
  Seed: RVLAMAIYK (TP53 R158L)
RALAMAIYM

SEQ ID NO: 18636 - protein, 9 aa, Artificial Sequence
  Description of Artificial Sequence: Synthetic peptide
  Seed: RVLAMAIYK (TP53 R158L)
RALAMAIYR

SEQ ID NO: 18637 - protein, 9 aa, Artificial Sequence
  Description of Artificial Sequence: Synthetic peptide
  Seed: RVLAMAIYK (TP53 R158L)
RALAMAIYS

SEQ ID NO: 18638 - protein, 9 aa, Artificial Sequence
  Description of Artificial Sequence: Synthetic peptide
  Seed: RVLAMAIYK (TP53 R158L)
RALAMAIYV

SEQ ID NO: 18639 - protein, 9 aa, Artificial Sequence
  Description of Artificial Sequence: Synthetic peptide
  Seed: RVLAMAIYK (TP53 R158L)
RALAMAIYY

SEQ ID NO: 18640 - protein, 9 aa, Artificial Sequence
  Description of Artificial Sequence: Synthetic peptide
  Seed: RVLAMAIYK (TP53 R158L)
RCLAMAIYK

SEQ ID NO: 18641 - protein, 10 aa, Artificial Sequence
  Description of Artificial Sequence: Synthetic peptide
  Seed: RVLAMAIYKQ (TP53 R158L)
RCLAMAIYKK

SEQ ID NO: 18642 - protein, 10 aa, Artificial Sequence
  Description of Artificial Sequence: Synthetic peptide
  Seed: RVLAMAIYKQ (TP53 R158L)
RCLAMAIYKR

SEQ ID NO: 18643 - protein, 9 aa, Artificial Sequence
  Description of Artificial Sequence: Synthetic peptide
  Seed: RVLAMAIYK (TP53 R158L)
RCLAMAIYR

SEQ ID NO: 18644 - protein, 10 aa, Artificial Sequence
  Description of Artificial Sequence: Synthetic peptide
  Seed: RVLAMAIYKQ (TP53 R158L)
RDLAMAIYKK

SEQ ID NO: 18645 - protein, 10 aa, Artificial Sequence
  Description of Artificial Sequence: Synthetic peptide
  Seed: RVLAMAIYKQ (TP53 R158L)
RDLAMAIYKR

SEQ ID NO: 18646 - protein, 9 aa, Artificial Sequence
  Description of Artificial Sequence: Synthetic peptide
  Seed: RVLAMAIYK (TP53 R158L)
RDLAMAIYR

SEQ ID NO: 18647 - protein, 8 aa, Artificial Sequence
  Description of Artificial Sequence: Synthetic peptide
  Seed: RVLAMAIY (TP53 R158L)
RELAMAIF

SEQ ID NO: 18648 - protein, 8 aa, Artificial Sequence
  Description of Artificial Sequence: Synthetic peptide
  Seed: RVLAMAIY (TP53 R158L)
RELAMAIM

SEQ ID NO: 18649 - protein, 8 aa, Artificial Sequence
  Description of Artificial Sequence: Synthetic peptide
  Seed: RVLAMAIY (TP53 R158L)
RELAMAIY

SEQ ID NO: 18650 - protein, 9 aa, Artificial Sequence
  Description of Artificial Sequence: Synthetic peptide
  Seed: RVLAMAIYK (TP53 R158L)
RELAMAIYK

SEQ ID NO: 18651 - protein, 10 aa, Artificial Sequence
  Description of Artificial Sequence: Synthetic peptide
  Seed: RVLAMAIYKQ (TP53 R158L)
RELAMAIYKK

SEQ ID NO: 18652 - protein, 10 aa, Artificial Sequence
  Description of Artificial Sequence: Synthetic peptide
  Seed: RVLAMAIYKQ (TP53 R158L)
RELAMAIYKR

SEQ ID NO: 18653 - protein, 9 aa, Artificial Sequence
  Description of Artificial Sequence: Synthetic peptide
  Seed: RVLAMAIYK (TP53 R158L)
RELAMAIYR

SEQ ID NO: 18654 - protein, 8 aa, Artificial Sequence
  Description of Artificial Sequence: Synthetic peptide
  Seed: RVLAMAIY (TP53 R158L)
RFLAMAIY

SEQ ID NO: 18655 - protein, 9 aa, Artificial Sequence
  Description of Artificial Sequence: Synthetic peptide
  Seed: RVLAMAIYK (TP53 R158L)
RFLAMAIYA

SEQ ID NO: 18656 - protein, 9 aa, Artificial Sequence
  Description of Artificial Sequence: Synthetic peptide
  Seed: RVLAMAIYK (TP53 R158L)
RFLAMAIYH

SEQ ID NO: 18657 - protein, 9 aa, Artificial Sequence
  Description of Artificial Sequence: Synthetic peptide
  Seed: RVLAMAIYK (TP53 R158L)
RFLAMAIYI

SEQ ID NO: 18658 - protein, 9 aa, Artificial Sequence
  Description of Artificial Sequence: Synthetic peptide
  Seed: RVLAMAIYK (TP53 R158L)
RFLAMAIYK

SEQ ID NO: 18659 - protein, 10 aa, Artificial Sequence
  Description of Artificial Sequence: Synthetic peptide
  Seed: RVLAMAIYKQ (TP53 R158L)
RFLAMAIYKA

SEQ ID NO: 18660 - protein, 10 aa, Artificial Sequence
  Description of Artificial Sequence: Synthetic peptide
  Seed: RVLAMAIYKQ (TP53 R158L)
RFLAMAIYKC

SEQ ID NO: 18661 - protein, 10 aa, Artificial Sequence
  Description of Artificial Sequence: Synthetic peptide
  Seed: RVLAMAIYKQ (TP53 R158L)
RFLAMAIYKD

SEQ ID NO: 18662 - protein, 10 aa, Artificial Sequence
  Description of Artificial Sequence: Synthetic peptide
  Seed: RVLAMAIYKQ (TP53 R158L)
RFLAMAIYKE

SEQ ID NO: 18663 - protein, 10 aa, Artificial Sequence
  Description of Artificial Sequence: Synthetic peptide
  Seed: RVLAMAIYKQ (TP53 R158L)
RFLAMAIYKF

SEQ ID NO: 18664 - protein, 10 aa, Artificial Sequence
  Description of Artificial Sequence: Synthetic peptide
  Seed: RVLAMAIYKQ (TP53 R158L)
RFLAMAIYKG

SEQ ID NO: 18665 - protein, 10 aa, Artificial Sequence
  Description of Artificial Sequence: Synthetic peptide
  Seed: RVLAMAIYKQ (TP53 R158L)
RFLAMAIYKH

SEQ ID NO: 18666 - protein, 10 aa, Artificial Sequence
  Description of Artificial Sequence: Synthetic peptide
  Seed: RVLAMAIYKQ (TP53 R158L)
RFLAMAIYKI

SEQ ID NO: 18667 - protein, 10 aa, Artificial Sequence
  Description of Artificial Sequence: Synthetic peptide
  Seed: RVLAMAIYKQ (TP53 R158L)
RFLAMAIYKK

SEQ ID NO: 18668 - protein, 10 aa, Artificial Sequence
  Description of Artificial Sequence: Synthetic peptide
  Seed: RVLAMAIYKQ (TP53 R158L)
RFLAMAIYKL

SEQ ID NO: 18669 - protein, 10 aa, Artificial Sequence
  Description of Artificial Sequence: Synthetic peptide
  Seed: RVLAMAIYKQ (TP53 R158L)
RFLAMAIYKM

SEQ ID NO: 18670 - protein, 10 aa, Artificial Sequence
  Description of Artificial Sequence: Synthetic peptide
  Seed: RVLAMAIYKQ (TP53 R158L)
RFLAMAIYKN

SEQ ID NO: 18671 - protein, 10 aa, Artificial Sequence
  Description of Artificial Sequence: Synthetic peptide
  Seed: RVLAMAIYKQ (TP53 R158L)
RFLAMAIYKP

SEQ ID NO: 18672 - protein, 10 aa, Artificial Sequence
  Description of Artificial Sequence: Synthetic peptide
  Seed: RVLAMAIYKQ (TP53 R158L)
RFLAMAIYKQ

SEQ ID NO: 18673 - protein, 10 aa, Artificial Sequence
  Description of Artificial Sequence: Synthetic peptide
  Seed: RVLAMAIYKQ (TP53 R158L)
RFLAMAIYKR

SEQ ID NO: 18674 - protein, 10 aa, Artificial Sequence
  Description of Artificial Sequence: Synthetic peptide
  Seed: RVLAMAIYKQ (TP53 R158L)
RFLAMAIYKS

SEQ ID NO: 18675 - protein, 10 aa, Artificial Sequence
  Description of Artificial Sequence: Synthetic peptide
  Seed: RVLAMAIYKQ (TP53 R158L)
RFLAMAIYKT

SEQ ID NO: 18676 - protein, 10 aa, Artificial Sequence
  Description of Artificial Sequence: Synthetic peptide
  Seed: RVLAMAIYKQ (TP53 R158L)
RFLAMAIYKV

SEQ ID NO: 18677 - protein, 10 aa, Artificial Sequence
  Description of Artificial Sequence: Synthetic peptide
  Seed: RVLAMAIYKQ (TP53 R158L)
RFLAMAIYKW

SEQ ID NO: 18678 - protein, 10 aa, Artificial Sequence
  Description of Artificial Sequence: Synthetic peptide
  Seed: RVLAMAIYKQ (TP53 R158L)
RFLAMAIYKY

SEQ ID NO: 18679 - protein, 9 aa, Artificial Sequence
  Description of Artificial Sequence: Synthetic peptide
  Seed: RVLAMAIYK (TP53 R158L)
RFLAMAIYL

SEQ ID NO: 18680 - protein, 9 aa, Artificial Sequence
  Description of Artificial Sequence: Synthetic peptide
  Seed: RVLAMAIYK (TP53 R158L)
RFLAMAIYM

SEQ ID NO: 18681 - protein, 9 aa, Artificial Sequence
  Description of Artificial Sequence: Synthetic peptide
  Seed: RVLAMAIYK (TP53 R158L)
RFLAMAIYR

SEQ ID NO: 18682 - protein, 9 aa, Artificial Sequence
  Description of Artificial Sequence: Synthetic peptide
  Seed: RVLAMAIYK (TP53 R158L)
RFLAMAIYS

SEQ ID NO: 18683 - protein, 9 aa, Artificial Sequence
  Description of Artificial Sequence: Synthetic peptide
  Seed: RVLAMAIYK (TP53 R158L)
RFLAMAIYV

SEQ ID NO: 18684 - protein, 9 aa, Artificial Sequence
  Description of Artificial Sequence: Synthetic peptide
  Seed: RVLAMAIYK (TP53 R158L)
RFLAMAIYY

SEQ ID NO: 18685 - protein, 9 aa, Artificial Sequence
  Description of Artificial Sequence: Synthetic peptide
  Seed: RVLAMAIYK (TP53 R158L)
RGLAMAIYA

SEQ ID NO: 18686 - protein, 9 aa, Artificial Sequence
  Description of Artificial Sequence: Synthetic peptide
  Seed: RVLAMAIYK (TP53 R158L)
RGLAMAIYH

SEQ ID NO: 18687 - protein, 9 aa, Artificial Sequence
  Description of Artificial Sequence: Synthetic peptide
  Seed: RVLAMAIYK (TP53 R158L)
RGLAMAIYK

SEQ ID NO: 18688 - protein, 10 aa, Artificial Sequence
  Description of Artificial Sequence: Synthetic peptide
  Seed: RVLAMAIYKQ (TP53 R158L)
RGLAMAIYKK

SEQ ID NO: 18689 - protein, 10 aa, Artificial Sequence
  Description of Artificial Sequence: Synthetic peptide
  Seed: RVLAMAIYKQ (TP53 R158L)
RGLAMAIYKR

SEQ ID NO: 18690 - protein, 9 aa, Artificial Sequence
  Description of Artificial Sequence: Synthetic peptide
  Seed: RVLAMAIYK (TP53 R158L)
RGLAMAIYR

SEQ ID NO: 18691 - protein, 9 aa, Artificial Sequence
  Description of Artificial Sequence: Synthetic peptide
  Seed: RVLAMAIYK (TP53 R158L)
RGLAMAIYV

SEQ ID NO: 18692 - protein, 8 aa, Artificial Sequence
  Description of Artificial Sequence: Synthetic peptide
  Seed: RVLAMAIY (TP53 R158L)
RHLAMAIF

SEQ ID NO: 18693 - protein, 8 aa, Artificial Sequence
  Description of Artificial Sequence: Synthetic peptide
  Seed: RVLAMAIY (TP53 R158L)
RHLAMAIY

SEQ ID NO: 18694 - protein, 9 aa, Artificial Sequence
  Description of Artificial Sequence: Synthetic peptide
  Seed: RVLAMAIYK (TP53 R158L)
RHLAMAIYK

SEQ ID NO: 18695 - protein, 10 aa, Artificial Sequence
  Description of Artificial Sequence: Synthetic peptide
  Seed: RVLAMAIYKQ (TP53 R158L)
RHLAMAIYKK

SEQ ID NO: 18696 - protein, 10 aa, Artificial Sequence
  Description of Artificial Sequence: Synthetic peptide
  Seed: RVLAMAIYKQ (TP53 R158L)
RHLAMAIYKR

SEQ ID NO: 18697 - protein, 9 aa, Artificial Sequence
  Description of Artificial Sequence: Synthetic peptide
  Seed: RVLAMAIYK (TP53 R158L)
RHLAMAIYR

SEQ ID NO: 18698 - protein, 8 aa, Artificial Sequence
  Description of Artificial Sequence: Synthetic peptide
  Seed: RVLAMAIY (TP53 R158L)
RILAMAIF

SEQ ID NO: 18699 - protein, 8 aa, Artificial Sequence
  Description of Artificial Sequence: Synthetic peptide
  Seed: RVLAMAIY (TP53 R158L)
RILAMAIY

SEQ ID NO: 18700 - protein, 9 aa, Artificial Sequence
  Description of Artificial Sequence: Synthetic peptide
  Seed: RVLAMAIYK (TP53 R158L)
RILAMAIYA

SEQ ID NO: 18701 - protein, 9 aa, Artificial Sequence
  Description of Artificial Sequence: Synthetic peptide
  Seed: RVLAMAIYK (TP53 R158L)
RILAMAIYG

SEQ ID NO: 18702 - protein, 9 aa, Artificial Sequence
  Description of Artificial Sequence: Synthetic peptide
  Seed: RVLAMAIYK (TP53 R158L)
RILAMAIYH

SEQ ID NO: 18703 - protein, 9 aa, Artificial Sequence
  Description of Artificial Sequence: Synthetic peptide
  Seed: RVLAMAIYK (TP53 R158L)
RILAMAIYI

SEQ ID NO: 18704 - protein, 9 aa, Artificial Sequence
  Description of Artificial Sequence: Synthetic peptide
  Seed: RVLAMAIYK (TP53 R158L)
RILAMAIYK

SEQ ID NO: 18705 - protein, 10 aa, Artificial Sequence
  Description of Artificial Sequence: Synthetic peptide
  Seed: RVLAMAIYKQ (TP53 R158L)
RILAMAIYKA

SEQ ID NO: 18706 - protein, 10 aa, Artificial Sequence
  Description of Artificial Sequence: Synthetic peptide
  Seed: RVLAMAIYKQ (TP53 R158L)
RILAMAIYKC

SEQ ID NO: 18707 - protein, 10 aa, Artificial Sequence
  Description of Artificial Sequence: Synthetic peptide
  Seed: RVLAMAIYKQ (TP53 R158L)
RILAMAIYKD

SEQ ID NO: 18708 - protein, 10 aa, Artificial Sequence
  Description of Artificial Sequence: Synthetic peptide
  Seed: RVLAMAIYKQ (TP53 R158L)
RILAMAIYKE

SEQ ID NO: 18709 - protein, 10 aa, Artificial Sequence
  Description of Artificial Sequence: Synthetic peptide
  Seed: RVLAMAIYKQ (TP53 R158L)
RILAMAIYKF

SEQ ID NO: 18710 - protein, 10 aa, Artificial Sequence
  Description of Artificial Sequence: Synthetic peptide
  Seed: RVLAMAIYKQ (TP53 R158L)
RILAMAIYKG

SEQ ID NO: 18711 - protein, 10 aa, Artificial Sequence
  Description of Artificial Sequence: Synthetic peptide
  Seed: RVLAMAIYKQ (TP53 R158L)
RILAMAIYKH

SEQ ID NO: 18712 - protein, 10 aa, Artificial Sequence
  Description of Artificial Sequence: Synthetic peptide
  Seed: RVLAMAIYKQ (TP53 R158L)
RILAMAIYKI

SEQ ID NO: 18713 - protein, 10 aa, Artificial Sequence
  Description of Artificial Sequence: Synthetic peptide
  Seed: RVLAMAIYKQ (TP53 R158L)
RILAMAIYKK

SEQ ID NO: 18714 - protein, 10 aa, Artificial Sequence
  Description of Artificial Sequence: Synthetic peptide
  Seed: RVLAMAIYKQ (TP53 R158L)
RILAMAIYKL

SEQ ID NO: 18715 - protein, 10 aa, Artificial Sequence
  Description of Artificial Sequence: Synthetic peptide
  Seed: RVLAMAIYKQ (TP53 R158L)
RILAMAIYKM

SEQ ID NO: 18716 - protein, 10 aa, Artificial Sequence
  Description of Artificial Sequence: Synthetic peptide
  Seed: RVLAMAIYKQ (TP53 R158L)
RILAMAIYKN

SEQ ID NO: 18717 - protein, 10 aa, Artificial Sequence
  Description of Artificial Sequence: Synthetic peptide
  Seed: RVLAMAIYKQ (TP53 R158L)
RILAMAIYKP

SEQ ID NO: 18718 - protein, 10 aa, Artificial Sequence
  Description of Artificial Sequence: Synthetic peptide
  Seed: RVLAMAIYKQ (TP53 R158L)
RILAMAIYKQ

SEQ ID NO: 18719 - protein, 10 aa, Artificial Sequence
  Description of Artificial Sequence: Synthetic peptide
  Seed: RVLAMAIYKQ (TP53 R158L)
RILAMAIYKR

SEQ ID NO: 18720 - protein, 10 aa, Artificial Sequence
  Description of Artificial Sequence: Synthetic peptide
  Seed: RVLAMAIYKQ (TP53 R158L)
RILAMAIYKS

SEQ ID NO: 18721 - protein, 10 aa, Artificial Sequence
  Description of Artificial Sequence: Synthetic peptide
  Seed: RVLAMAIYKQ (TP53 R158L)
RILAMAIYKT

SEQ ID NO: 18722 - protein, 10 aa, Artificial Sequence
  Description of Artificial Sequence: Synthetic peptide
  Seed: RVLAMAIYKQ (TP53 R158L)
RILAMAIYKV

SEQ ID NO: 18723 - protein, 10 aa, Artificial Sequence
  Description of Artificial Sequence: Synthetic peptide
  Seed: RVLAMAIYKQ (TP53 R158L)
RILAMAIYKW

SEQ ID NO: 18724 - protein, 10 aa, Artificial Sequence
  Description of Artificial Sequence: Synthetic peptide
  Seed: RVLAMAIYKQ (TP53 R158L)
RILAMAIYKY

SEQ ID NO: 18725 - protein, 9 aa, Artificial Sequence
  Description of Artificial Sequence: Synthetic peptide
  Seed: RVLAMAIYK (TP53 R158L)
RILAMAIYL

SEQ ID NO: 18726 - protein, 9 aa, Artificial Sequence
  Description of Artificial Sequence: Synthetic peptide
  Seed: RVLAMAIYK (TP53 R158L)
RILAMAIYM

SEQ ID NO: 18727 - protein, 9 aa, Artificial Sequence
  Description of Artificial Sequence: Synthetic peptide
  Seed: RVLAMAIYK (TP53 R158L)
RILAMAIYR

SEQ ID NO: 18728 - protein, 9 aa, Artificial Sequence
  Description of Artificial Sequence: Synthetic peptide
  Seed: RVLAMAIYK (TP53 R158L)
RILAMAIYS

SEQ ID NO: 18729 - protein, 9 aa, Artificial Sequence
  Description of Artificial Sequence: Synthetic peptide
  Seed: RVLAMAIYK (TP53 R158L)
RILAMAIYV

SEQ ID NO: 18730 - protein, 9 aa, Artificial Sequence
  Description of Artificial Sequence: Synthetic peptide
  Seed: RVLAMAIYK (TP53 R158L)
RILAMAIYY

SEQ ID NO: 18731 - protein, 8 aa, Artificial Sequence
  Description of Artificial Sequence: Synthetic peptide
  Seed: RVLAMAIY (TP53 R158L)
RKLAMAIF

SEQ ID NO: 18732 - protein, 8 aa, Artificial Sequence
  Description of Artificial Sequence: Synthetic peptide
  Seed: RVLAMAIY (TP53 R158L)
RKLAMAIM

SEQ ID NO: 18733 - protein, 8 aa, Artificial Sequence
  Description of Artificial Sequence: Synthetic peptide
  Seed: RVLAMAIY (TP53 R158L)
RKLAMAIY

SEQ ID NO: 18734 - protein, 9 aa, Artificial Sequence
  Description of Artificial Sequence: Synthetic peptide
  Seed: RVLAMAIYK (TP53 R158L)
RKLAMAIYK

SEQ ID NO: 18735 - protein, 10 aa, Artificial Sequence
  Description of Artificial Sequence: Synthetic peptide
  Seed: RVLAMAIYKQ (TP53 R158L)
RKLAMAIYKK

SEQ ID NO: 18736 - protein, 10 aa, Artificial Sequence
  Description of Artificial Sequence: Synthetic peptide
  Seed: RVLAMAIYKQ (TP53 R158L)
RKLAMAIYKR

SEQ ID NO: 18737 - protein, 9 aa, Artificial Sequence
  Description of Artificial Sequence: Synthetic peptide
  Seed: RVLAMAIYK (TP53 R158L)
RKLAMAIYR

SEQ ID NO: 18738 - protein, 8 aa, Artificial Sequence
  Description of Artificial Sequence: Synthetic peptide
  Seed: RVLAMAIY (TP53 R158L)
RLLAMAIF

SEQ ID NO: 18739 - protein, 8 aa, Artificial Sequence
  Description of Artificial Sequence: Synthetic peptide
  Seed: RVLAMAIY (TP53 R158L)
RLLAMAIY

SEQ ID NO: 18740 - protein, 9 aa, Artificial Sequence
  Description of Artificial Sequence: Synthetic peptide
  Seed: RVLAMAIYK (TP53 R158L)
RLLAMAIYA

SEQ ID NO: 18741 - protein, 9 aa, Artificial Sequence
  Description of Artificial Sequence: Synthetic peptide
  Seed: RVLAMAIYK (TP53 R158L)
RLLAMAIYH

SEQ ID NO: 18742 - protein, 9 aa, Artificial Sequence
  Description of Artificial Sequence: Synthetic peptide
  Seed: RVLAMAIYK (TP53 R158L)
RLLAMAIYK

SEQ ID NO: 18743 - protein, 10 aa, Artificial Sequence
  Description of Artificial Sequence: Synthetic peptide
  Seed: RVLAMAIYKQ (TP53 R158L)
RLLAMAIYKA

SEQ ID NO: 18744 - protein, 10 aa, Artificial Sequence
  Description of Artificial Sequence: Synthetic peptide
  Seed: RVLAMAIYKQ (TP53 R158L)
RLLAMAIYKC

SEQ ID NO: 18745 - protein, 10 aa, Artificial Sequence
  Description of Artificial Sequence: Synthetic peptide
  Seed: RVLAMAIYKQ (TP53 R158L)
RLLAMAIYKD

SEQ ID NO: 18746 - protein, 10 aa, Artificial Sequence
  Description of Artificial Sequence: Synthetic peptide
  Seed: RVLAMAIYKQ (TP53 R158L)
RLLAMAIYKE

SEQ ID NO: 18747 - protein, 10 aa, Artificial Sequence
  Description of Artificial Sequence: Synthetic peptide
  Seed: RVLAMAIYKQ (TP53 R158L)
RLLAMAIYKF

SEQ ID NO: 18748 - protein, 10 aa, Artificial Sequence
  Description of Artificial Sequence: Synthetic peptide
  Seed: RVLAMAIYKQ (TP53 R158L)
RLLAMAIYKG

SEQ ID NO: 18749 - protein, 10 aa, Artificial Sequence
  Description of Artificial Sequence: Synthetic peptide
  Seed: RVLAMAIYKQ (TP53 R158L)
RLLAMAIYKH

SEQ ID NO: 18750 - protein, 10 aa, Artificial Sequence
  Description of Artificial Sequence: Synthetic peptide
  Seed: RVLAMAIYKQ (TP53 R158L)
RLLAMAIYKI

SEQ ID NO: 18751 - protein, 10 aa, Artificial Sequence
  Description of Artificial Sequence: Synthetic peptide
  Seed: RVLAMAIYKQ (TP53 R158L)
RLLAMAIYKK

SEQ ID NO: 18752 - protein, 10 aa, Artificial Sequence
  Description of Artificial Sequence: Synthetic peptide
  Seed: RVLAMAIYKQ (TP53 R158L)
RLLAMAIYKL

SEQ ID NO: 18753 - protein, 10 aa, Artificial Sequence
  Description of Artificial Sequence: Synthetic peptide
  Seed: RVLAMAIYKQ (TP53 R158L)
RLLAMAIYKM

SEQ ID NO: 18754 - protein, 10 aa, Artificial Sequence
  Description of Artificial Sequence: Synthetic peptide
  Seed: RVLAMAIYKQ (TP53 R158L)
RLLAMAIYKN

SEQ ID NO: 18755 - protein, 10 aa, Artificial Sequence
  Description of Artificial Sequence: Synthetic peptide
  Seed: RVLAMAIYKQ (TP53 R158L)
RLLAMAIYKP

SEQ ID NO: 18756 - protein, 10 aa, Artificial Sequence
  Description of Artificial Sequence: Synthetic peptide
  Seed: RVLAMAIYKQ (TP53 R158L)
RLLAMAIYKQ

SEQ ID NO: 18757 - protein, 10 aa, Artificial Sequence
  Description of Artificial Sequence: Synthetic peptide
  Seed: RVLAMAIYKQ (TP53 R158L)
RLLAMAIYKR

SEQ ID NO: 18758 - protein, 10 aa, Artificial Sequence
  Description of Artificial Sequence: Synthetic peptide
  Seed: RVLAMAIYKQ (TP53 R158L)
RLLAMAIYKS

SEQ ID NO: 18759 - protein, 10 aa, Artificial Sequence
  Description of Artificial Sequence: Synthetic peptide
  Seed: RVLAMAIYKQ (TP53 R158L)
RLLAMAIYKT

SEQ ID NO: 18760 - protein, 10 aa, Artificial Sequence
  Description of Artificial Sequence: Synthetic peptide
  Seed: RVLAMAIYKQ (TP53 R158L)
RLLAMAIYKV

SEQ ID NO: 18761 - protein, 10 aa, Artificial Sequence
  Description of Artificial Sequence: Synthetic peptide
  Seed: RVLAMAIYKQ (TP53 R158L)
RLLAMAIYKW

SEQ ID NO: 18762 - protein, 10 aa, Artificial Sequence
  Description of Artificial Sequence: Synthetic peptide
  Seed: RVLAMAIYKQ (TP53 R158L)
RLLAMAIYKY

SEQ ID NO: 18763 - protein, 9 aa, Artificial Sequence
  Description of Artificial Sequence: Synthetic peptide
  Seed: RVLAMAIYK (TP53 R158L)
RLLAMAIYR

SEQ ID NO: 18764 - protein, 9 aa, Artificial Sequence
  Description of Artificial Sequence: Synthetic peptide
  Seed: RVLAMAIYK (TP53 R158L)
RLLAMAIYY

SEQ ID NO: 18765 - protein, 8 aa, Artificial Sequence
  Description of Artificial Sequence: Synthetic peptide
  Seed: RVLAMAIY (TP53 R158L)
RMLAMAIL

SEQ ID NO: 18766 - protein, 8 aa, Artificial Sequence
  Description of Artificial Sequence: Synthetic peptide
  Seed: RVLAMAIY (TP53 R158L)
RMLAMAIM

SEQ ID NO: 18767 - protein, 8 aa, Artificial Sequence
  Description of Artificial Sequence: Synthetic peptide
  Seed: RVLAMAIY (TP53 R158L)
RMLAMAIY

SEQ ID NO: 18768 - protein, 9 aa, Artificial Sequence
  Description of Artificial Sequence: Synthetic peptide
  Seed: RVLAMAIYK (TP53 R158L)
RMLAMAIYA

SEQ ID NO: 18769 - protein, 9 aa, Artificial Sequence
  Description of Artificial Sequence: Synthetic peptide
  Seed: RVLAMAIYK (TP53 R158L)
RMLAMAIYF

SEQ ID NO: 18770 - protein, 9 aa, Artificial Sequence
  Description of Artificial Sequence: Synthetic peptide
  Seed: RVLAMAIYK (TP53 R158L)
RMLAMAIYG

SEQ ID NO: 18771 - protein, 9 aa, Artificial Sequence
  Description of Artificial Sequence: Synthetic peptide
  Seed: RVLAMAIYK (TP53 R158L)
RMLAMAIYH

SEQ ID NO: 18772 - protein, 9 aa, Artificial Sequence
  Description of Artificial Sequence: Synthetic peptide
  Seed: RVLAMAIYK (TP53 R158L)
RMLAMAIYI

SEQ ID NO: 18773 - protein, 10 aa, Artificial Sequence
  Description of Artificial Sequence: Synthetic peptide
  Seed: RVLAMAIYKQ (TP53 R158L)
RMLAMAIYKA

SEQ ID NO: 18774 - protein, 10 aa, Artificial Sequence
  Description of Artificial Sequence: Synthetic peptide
  Seed: RVLAMAIYKQ (TP53 R158L)
RMLAMAIYKC

SEQ ID NO: 18775 - protein, 10 aa, Artificial Sequence
  Description of Artificial Sequence: Synthetic peptide
  Seed: RVLAMAIYKQ (TP53 R158L)
RMLAMAIYKD

SEQ ID NO: 18776 - protein, 10 aa, Artificial Sequence
  Description of Artificial Sequence: Synthetic peptide
  Seed: RVLAMAIYKQ (TP53 R158L)
RMLAMAIYKE

SEQ ID NO: 18777 - protein, 10 aa, Artificial Sequence
  Description of Artificial Sequence: Synthetic peptide
  Seed: RVLAMAIYKQ (TP53 R158L)
RMLAMAIYKF

SEQ ID NO: 18778 - protein, 10 aa, Artificial Sequence
  Description of Artificial Sequence: Synthetic peptide
  Seed: RVLAMAIYKQ (TP53 R158L)
RMLAMAIYKG

SEQ ID NO: 18779 - protein, 10 aa, Artificial Sequence
  Description of Artificial Sequence: Synthetic peptide
  Seed: RVLAMAIYKQ (TP53 R158L)
RMLAMAIYKH

SEQ ID NO: 18780 - protein, 10 aa, Artificial Sequence
  Description of Artificial Sequence: Synthetic peptide
  Seed: RVLAMAIYKQ (TP53 R158L)
RMLAMAIYKI

SEQ ID NO: 18781 - protein, 10 aa, Artificial Sequence
  Description of Artificial Sequence: Synthetic peptide
  Seed: RVLAMAIYKQ (TP53 R158L)
RMLAMAIYKK

SEQ ID NO: 18782 - protein, 10 aa, Artificial Sequence
  Description of Artificial Sequence: Synthetic peptide
  Seed: RVLAMAIYKQ (TP53 R158L)
RMLAMAIYKL

SEQ ID NO: 18783 - protein, 10 aa, Artificial Sequence
  Description of Artificial Sequence: Synthetic peptide
  Seed: RVLAMAIYKQ (TP53 R158L)
RMLAMAIYKM

SEQ ID NO: 18784 - protein, 10 aa, Artificial Sequence
  Description of Artificial Sequence: Synthetic peptide
  Seed: RVLAMAIYKQ (TP53 R158L)
RMLAMAIYKN

SEQ ID NO: 18785 - protein, 10 aa, Artificial Sequence
  Description of Artificial Sequence: Synthetic peptide
  Seed: RVLAMAIYKQ (TP53 R158L)
RMLAMAIYKP

SEQ ID NO: 18786 - protein, 10 aa, Artificial Sequence
  Description of Artificial Sequence: Synthetic peptide
  Seed: RVLAMAIYKQ (TP53 R158L)
RMLAMAIYKQ

SEQ ID NO: 18787 - protein, 10 aa, Artificial Sequence
  Description of Artificial Sequence: Synthetic peptide
  Seed: RVLAMAIYKQ (TP53 R158L)
RMLAMAIYKR

SEQ ID NO: 18788 - protein, 10 aa, Artificial Sequence
  Description of Artificial Sequence: Synthetic peptide
  Seed: RVLAMAIYKQ (TP53 R158L)
RMLAMAIYKS

SEQ ID NO: 18789 - protein, 10 aa, Artificial Sequence
  Description of Artificial Sequence: Synthetic peptide
  Seed: RVLAMAIYKQ (TP53 R158L)
RMLAMAIYKT

SEQ ID NO: 18790 - protein, 10 aa, Artificial Sequence
  Description of Artificial Sequence: Synthetic peptide
  Seed: RVLAMAIYKQ (TP53 R158L)
RMLAMAIYKV

SEQ ID NO: 18791 - protein, 10 aa, Artificial Sequence
  Description of Artificial Sequence: Synthetic peptide
  Seed: RVLAMAIYKQ (TP53 R158L)
RMLAMAIYKW

SEQ ID NO: 18792 - protein, 10 aa, Artificial Sequence
  Description of Artificial Sequence: Synthetic peptide
  Seed: RVLAMAIYKQ (TP53 R158L)
RMLAMAIYKY

SEQ ID NO: 18793 - protein, 9 aa, Artificial Sequence
  Description of Artificial Sequence: Synthetic peptide
  Seed: RVLAMAIYK (TP53 R158L)
RMLAMAIYL

SEQ ID NO: 18794 - protein, 9 aa, Artificial Sequence
  Description of Artificial Sequence: Synthetic peptide
  Seed: RVLAMAIYK (TP53 R158L)
RMLAMAIYM

SEQ ID NO: 18795 - protein, 9 aa, Artificial Sequence
  Description of Artificial Sequence: Synthetic peptide
  Seed: RVLAMAIYK (TP53 R158L)
RMLAMAIYQ

SEQ ID NO: 18796 - protein, 9 aa, Artificial Sequence
  Description of Artificial Sequence: Synthetic peptide
  Seed: RVLAMAIYK (TP53 R158L)
RMLAMAIYR

SEQ ID NO: 18797 - protein, 9 aa, Artificial Sequence
  Description of Artificial Sequence: Synthetic peptide
  Seed: RVLAMAIYK (TP53 R158L)
RMLAMAIYS

SEQ ID NO: 18798 - protein, 9 aa, Artificial Sequence
  Description of Artificial Sequence: Synthetic peptide
  Seed: RVLAMAIYK (TP53 R158L)
RMLAMAIYV

SEQ ID NO: 18799 - protein, 9 aa, Artificial Sequence
  Description of Artificial Sequence: Synthetic peptide
  Seed: RVLAMAIYK (TP53 R158L)
RMLAMAIYY

SEQ ID NO: 18800 - protein, 8 aa, Artificial Sequence
  Description of Artificial Sequence: Synthetic peptide
  Seed: RVLAMAIY (TP53 R158L)
RNLAMAIY

SEQ ID NO: 18801 - protein, 9 aa, Artificial Sequence
  Description of Artificial Sequence: Synthetic peptide
  Seed: RVLAMAIYK (TP53 R158L)
RNLAMAIYA

SEQ ID NO: 18802 - protein, 9 aa, Artificial Sequence
  Description of Artificial Sequence: Synthetic peptide
  Seed: RVLAMAIYK (TP53 R158L)
RNLAMAIYK

SEQ ID NO: 18803 - protein, 10 aa, Artificial Sequence
  Description of Artificial Sequence: Synthetic peptide
  Seed: RVLAMAIYKQ (TP53 R158L)
RNLAMAIYKK

SEQ ID NO: 18804 - protein, 10 aa, Artificial Sequence
  Description of Artificial Sequence: Synthetic peptide
  Seed: RVLAMAIYKQ (TP53 R158L)
RNLAMAIYKR

SEQ ID NO: 18805 - protein, 9 aa, Artificial Sequence
  Description of Artificial Sequence: Synthetic peptide
  Seed: RVLAMAIYK (TP53 R158L)
RNLAMAIYR

SEQ ID NO: 18806 - protein, 10 aa, Artificial Sequence
  Description of Artificial Sequence: Synthetic peptide
  Seed: RVLAMAIYKQ (TP53 R158L)
RPLAMAIYKK

SEQ ID NO: 18807 - protein, 10 aa, Artificial Sequence
  Description of Artificial Sequence: Synthetic peptide
  Seed: RVLAMAIYKQ (TP53 R158L)
RPLAMAIYKR

SEQ ID NO: 18808 - protein, 9 aa, Artificial Sequence
  Description of Artificial Sequence: Synthetic peptide
  Seed: RVLAMAIYK (TP53 R158L)
RPLAMAIYR

SEQ ID NO: 18809 - protein, 8 aa, Artificial Sequence
  Description of Artificial Sequence: Synthetic peptide
  Seed: RVLAMAIY (TP53 R158L)
RQLAMAIF

SEQ ID NO: 18810 - protein, 8 aa, Artificial Sequence
  Description of Artificial Sequence: Synthetic peptide
  Seed: RVLAMAIY (TP53 R158L)
RQLAMAII

SEQ ID NO: 18811 - protein, 8 aa, Artificial Sequence
  Description of Artificial Sequence: Synthetic peptide
  Seed: RVLAMAIY (TP53 R158L)
RQLAMAIL

SEQ ID NO: 18812 - protein, 8 aa, Artificial Sequence
  Description of Artificial Sequence: Synthetic peptide
  Seed: RVLAMAIY (TP53 R158L)
RQLAMAIM

SEQ ID NO: 18813 - protein, 8 aa, Artificial Sequence
  Description of Artificial Sequence: Synthetic peptide
  Seed: RVLAMAIY (TP53 R158L)
RQLAMAIV

SEQ ID NO: 18814 - protein, 8 aa, Artificial Sequence
  Description of Artificial Sequence: Synthetic peptide
  Seed: RVLAMAIY (TP53 R158L)
RQLAMAIW

SEQ ID NO: 18815 - protein, 9 aa, Artificial Sequence
  Description of Artificial Sequence: Synthetic peptide
  Seed: RVLAMAIYK (TP53 R158L)
RQLAMAIYA

SEQ ID NO: 18816 - protein, 9 aa, Artificial Sequence
  Description of Artificial Sequence: Synthetic peptide
  Seed: RVLAMAIYK (TP53 R158L)
RQLAMAIYH

SEQ ID NO: 18817 - protein, 9 aa, Artificial Sequence
  Description of Artificial Sequence: Synthetic peptide
  Seed: RVLAMAIYK (TP53 R158L)
RQLAMAIYI

SEQ ID NO: 18818 - protein, 9 aa, Artificial Sequence
  Description of Artificial Sequence: Synthetic peptide
  Seed: RVLAMAIYK (TP53 R158L)
RQLAMAIYK

SEQ ID NO: 18819 - protein, 10 aa, Artificial Sequence
  Description of Artificial Sequence: Synthetic peptide
  Seed: RVLAMAIYKQ (TP53 R158L)
RQLAMAIYKA

SEQ ID NO: 18820 - protein, 10 aa, Artificial Sequence
  Description of Artificial Sequence: Synthetic peptide
  Seed: RVLAMAIYKQ (TP53 R158L)
RQLAMAIYKC

SEQ ID NO: 18821 - protein, 10 aa, Artificial Sequence
  Description of Artificial Sequence: Synthetic peptide
  Seed: RVLAMAIYKQ (TP53 R158L)
RQLAMAIYKD

SEQ ID NO: 18822 - protein, 10 aa, Artificial Sequence
  Description of Artificial Sequence: Synthetic peptide
  Seed: RVLAMAIYKQ (TP53 R158L)
RQLAMAIYKE

SEQ ID NO: 18823 - protein, 10 aa, Artificial Sequence
  Description of Artificial Sequence: Synthetic peptide
  Seed: RVLAMAIYKQ (TP53 R158L)
RQLAMAIYKF

SEQ ID NO: 18824 - protein, 10 aa, Artificial Sequence
  Description of Artificial Sequence: Synthetic peptide
  Seed: RVLAMAIYKQ (TP53 R158L)
RQLAMAIYKG

SEQ ID NO: 18825 - protein, 10 aa, Artificial Sequence
  Description of Artificial Sequence: Synthetic peptide
  Seed: RVLAMAIYKQ (TP53 R158L)
RQLAMAIYKH

SEQ ID NO: 18826 - protein, 10 aa, Artificial Sequence
  Description of Artificial Sequence: Synthetic peptide
  Seed: RVLAMAIYKQ (TP53 R158L)
RQLAMAIYKI

SEQ ID NO: 18827 - protein, 10 aa, Artificial Sequence
  Description of Artificial Sequence: Synthetic peptide
  Seed: RVLAMAIYKQ (TP53 R158L)
RQLAMAIYKK

SEQ ID NO: 18828 - protein, 10 aa, Artificial Sequence
  Description of Artificial Sequence: Synthetic peptide
  Seed: RVLAMAIYKQ (TP53 R158L)
RQLAMAIYKL

SEQ ID NO: 18829 - protein, 10 aa, Artificial Sequence
  Description of Artificial Sequence: Synthetic peptide
  Seed: RVLAMAIYKQ (TP53 R158L)
RQLAMAIYKM

SEQ ID NO: 18830 - protein, 10 aa, Artificial Sequence
  Description of Artificial Sequence: Synthetic peptide
  Seed: RVLAMAIYKQ (TP53 R158L)
RQLAMAIYKN

SEQ ID NO: 18831 - protein, 10 aa, Artificial Sequence
  Description of Artificial Sequence: Synthetic peptide
  Seed: RVLAMAIYKQ (TP53 R158L)
RQLAMAIYKP

SEQ ID NO: 18832 - protein, 10 aa, Artificial Sequence
  Description of Artificial Sequence: Synthetic peptide
  Seed: RVLAMAIYKQ (TP53 R158L)
RQLAMAIYKQ

SEQ ID NO: 18833 - protein, 10 aa, Artificial Sequence
  Description of Artificial Sequence: Synthetic peptide
  Seed: RVLAMAIYKQ (TP53 R158L)
RQLAMAIYKR

SEQ ID NO: 18834 - protein, 10 aa, Artificial Sequence
  Description of Artificial Sequence: Synthetic peptide
  Seed: RVLAMAIYKQ (TP53 R158L)
RQLAMAIYKS

SEQ ID NO: 18835 - protein, 10 aa, Artificial Sequence
  Description of Artificial Sequence: Synthetic peptide
  Seed: RVLAMAIYKQ (TP53 R158L)
RQLAMAIYKT

SEQ ID NO: 18836 - protein, 10 aa, Artificial Sequence
  Description of Artificial Sequence: Synthetic peptide
  Seed: RVLAMAIYKQ (TP53 R158L)
RQLAMAIYKV

SEQ ID NO: 18837 - protein, 10 aa, Artificial Sequence
  Description of Artificial Sequence: Synthetic peptide
  Seed: RVLAMAIYKQ (TP53 R158L)
RQLAMAIYKW

SEQ ID NO: 18838 - protein, 10 aa, Artificial Sequence
  Description of Artificial Sequence: Synthetic peptide
  Seed: RVLAMAIYKQ (TP53 R158L)
RQLAMAIYKY

SEQ ID NO: 18839 - protein, 9 aa, Artificial Sequence
  Description of Artificial Sequence: Synthetic peptide
  Seed: RVLAMAIYK (TP53 R158L)
RQLAMAIYM

SEQ ID NO: 18840 - protein, 9 aa, Artificial Sequence
  Description of Artificial Sequence: Synthetic peptide
  Seed: RVLAMAIYK (TP53 R158L)
RQLAMAIYR

SEQ ID NO: 18841 - protein, 9 aa, Artificial Sequence
  Description of Artificial Sequence: Synthetic peptide
  Seed: RVLAMAIYK (TP53 R158L)
RQLAMAIYV

SEQ ID NO: 18842 - protein, 9 aa, Artificial Sequence
  Description of Artificial Sequence: Synthetic peptide
  Seed: RVLAMAIYK (TP53 R158L)
RQLAMAIYY

SEQ ID NO: 18843 - protein, 8 aa, Artificial Sequence
  Description of Artificial Sequence: Synthetic peptide
  Seed: RVLAMAIY (TP53 R158L)
RRLAMAIY

SEQ ID NO: 18844 - protein, 9 aa, Artificial Sequence
  Description of Artificial Sequence: Synthetic peptide
  Seed: RVLAMAIYK (TP53 R158L)
RRLAMAIYK

SEQ ID NO: 18845 - protein, 10 aa, Artificial Sequence
  Description of Artificial Sequence: Synthetic peptide
  Seed: RVLAMAIYKQ (TP53 R158L)
RRLAMAIYKK

SEQ ID NO: 18846 - protein, 10 aa, Artificial Sequence
  Description of Artificial Sequence: Synthetic peptide
  Seed: RVLAMAIYKQ (TP53 R158L)
RRLAMAIYKR

SEQ ID NO: 18847 - protein, 9 aa, Artificial Sequence
  Description of Artificial Sequence: Synthetic peptide
  Seed: RVLAMAIYK (TP53 R158L)
RRLAMAIYR

SEQ ID NO: 18848 - protein, 8 aa, Artificial Sequence
  Description of Artificial Sequence: Synthetic peptide
  Seed: RVLAMAIY (TP53 R158L)
RSLAMAIF

SEQ ID NO: 18849 - protein, 8 aa, Artificial Sequence
  Description of Artificial Sequence: Synthetic peptide
  Seed: RVLAMAIY (TP53 R158L)
RSLAMAIY

SEQ ID NO: 18850 - protein, 9 aa, Artificial Sequence
  Description of Artificial Sequence: Synthetic peptide
  Seed: RVLAMAIYK (TP53 R158L)
RSLAMAIYA

SEQ ID NO: 18851 - protein, 9 aa, Artificial Sequence
  Description of Artificial Sequence: Synthetic peptide
  Seed: RVLAMAIYK (TP53 R158L)
RSLAMAIYG

SEQ ID NO: 18852 - protein, 9 aa, Artificial Sequence
  Description of Artificial Sequence: Synthetic peptide
  Seed: RVLAMAIYK (TP53 R158L)
RSLAMAIYH

SEQ ID NO: 18853 - protein, 9 aa, Artificial Sequence
  Description of Artificial Sequence: Synthetic peptide
  Seed: RVLAMAIYK (TP53 R158L)
RSLAMAIYI

SEQ ID NO: 18854 - protein, 9 aa, Artificial Sequence
  Description of Artificial Sequence: Synthetic peptide
  Seed: RVLAMAIYK (TP53 R158L)
RSLAMAIYK

SEQ ID NO: 18855 - protein, 10 aa, Artificial Sequence
  Description of Artificial Sequence: Synthetic peptide
  Seed: RVLAMAIYKQ (TP53 R158L)
RSLAMAIYKA

SEQ ID NO: 18856 - protein, 10 aa, Artificial Sequence
  Description of Artificial Sequence: Synthetic peptide
  Seed: RVLAMAIYKQ (TP53 R158L)
RSLAMAIYKC

SEQ ID NO: 18857 - protein, 10 aa, Artificial Sequence
  Description of Artificial Sequence: Synthetic peptide
  Seed: RVLAMAIYKQ (TP53 R158L)
RSLAMAIYKD

SEQ ID NO: 18858 - protein, 10 aa, Artificial Sequence
  Description of Artificial Sequence: Synthetic peptide
  Seed: RVLAMAIYKQ (TP53 R158L)
RSLAMAIYKE

SEQ ID NO: 18859 - protein, 10 aa, Artificial Sequence
  Description of Artificial Sequence: Synthetic peptide
  Seed: RVLAMAIYKQ (TP53 R158L)
RSLAMAIYKF

SEQ ID NO: 18860 - protein, 10 aa, Artificial Sequence
  Description of Artificial Sequence: Synthetic peptide
  Seed: RVLAMAIYKQ (TP53 R158L)
RSLAMAIYKG

SEQ ID NO: 18861 - protein, 10 aa, Artificial Sequence
  Description of Artificial Sequence: Synthetic peptide
  Seed: RVLAMAIYKQ (TP53 R158L)
RSLAMAIYKH

SEQ ID NO: 18862 - protein, 10 aa, Artificial Sequence
  Description of Artificial Sequence: Synthetic peptide
  Seed: RVLAMAIYKQ (TP53 R158L)
RSLAMAIYKI

SEQ ID NO: 18863 - protein, 10 aa, Artificial Sequence
  Description of Artificial Sequence: Synthetic peptide
  Seed: RVLAMAIYKQ (TP53 R158L)
RSLAMAIYKK

SEQ ID NO: 18864 - protein, 10 aa, Artificial Sequence
  Description of Artificial Sequence: Synthetic peptide
  Seed: RVLAMAIYKQ (TP53 R158L)
RSLAMAIYKL

SEQ ID NO: 18865 - protein, 10 aa, Artificial Sequence
  Description of Artificial Sequence: Synthetic peptide
  Seed: RVLAMAIYKQ (TP53 R158L)
RSLAMAIYKM

SEQ ID NO: 18866 - protein, 10 aa, Artificial Sequence
  Description of Artificial Sequence: Synthetic peptide
  Seed: RVLAMAIYKQ (TP53 R158L)
RSLAMAIYKN

SEQ ID NO: 18867 - protein, 10 aa, Artificial Sequence
  Description of Artificial Sequence: Synthetic peptide
  Seed: RVLAMAIYKQ (TP53 R158L)
RSLAMAIYKP

SEQ ID NO: 18868 - protein, 10 aa, Artificial Sequence
  Description of Artificial Sequence: Synthetic peptide
  Seed: RVLAMAIYKQ (TP53 R158L)
RSLAMAIYKQ

SEQ ID NO: 18869 - protein, 10 aa, Artificial Sequence
  Description of Artificial Sequence: Synthetic peptide
  Seed: RVLAMAIYKQ (TP53 R158L)
RSLAMAIYKR

SEQ ID NO: 18870 - protein, 10 aa, Artificial Sequence
  Description of Artificial Sequence: Synthetic peptide
  Seed: RVLAMAIYKQ (TP53 R158L)
RSLAMAIYKS

SEQ ID NO: 18871 - protein, 10 aa, Artificial Sequence
  Description of Artificial Sequence: Synthetic peptide
  Seed: RVLAMAIYKQ (TP53 R158L)
RSLAMAIYKT

SEQ ID NO: 18872 - protein, 10 aa, Artificial Sequence
  Description of Artificial Sequence: Synthetic peptide
  Seed: RVLAMAIYKQ (TP53 R158L)
RSLAMAIYKV

SEQ ID NO: 18873 - protein, 10 aa, Artificial Sequence
  Description of Artificial Sequence: Synthetic peptide
  Seed: RVLAMAIYKQ (TP53 R158L)
RSLAMAIYKW

SEQ ID NO: 18874 - protein, 10 aa, Artificial Sequence
  Description of Artificial Sequence: Synthetic peptide
  Seed: RVLAMAIYKQ (TP53 R158L)
RSLAMAIYKY

SEQ ID NO: 18875 - protein, 9 aa, Artificial Sequence
  Description of Artificial Sequence: Synthetic peptide
  Seed: RVLAMAIYK (TP53 R158L)
RSLAMAIYL

SEQ ID NO: 18876 - protein, 9 aa, Artificial Sequence
  Description of Artificial Sequence: Synthetic peptide
  Seed: RVLAMAIYK (TP53 R158L)
RSLAMAIYM

SEQ ID NO: 18877 - protein, 9 aa, Artificial Sequence
  Description of Artificial Sequence: Synthetic peptide
  Seed: RVLAMAIYK (TP53 R158L)
RSLAMAIYR

SEQ ID NO: 18878 - protein, 9 aa, Artificial Sequence
  Description of Artificial Sequence: Synthetic peptide
  Seed: RVLAMAIYK (TP53 R158L)
RSLAMAIYS

SEQ ID NO: 18879 - protein, 9 aa, Artificial Sequence
  Description of Artificial Sequence: Synthetic peptide
  Seed: RVLAMAIYK (TP53 R158L)
RSLAMAIYT

SEQ ID NO: 18880 - protein, 9 aa, Artificial Sequence
  Description of Artificial Sequence: Synthetic peptide
  Seed: RVLAMAIYK (TP53 R158L)
RSLAMAIYV

SEQ ID NO: 18881 - protein, 9 aa, Artificial Sequence
  Description of Artificial Sequence: Synthetic peptide
  Seed: RVLAMAIYK (TP53 R158L)
RSLAMAIYY

SEQ ID NO: 18882 - protein, 8 aa, Artificial Sequence
  Description of Artificial Sequence: Synthetic peptide
  Seed: RVLAMAIY (TP53 R158L)
RTLAMAIF

SEQ ID NO: 18883 - protein, 8 aa, Artificial Sequence
  Description of Artificial Sequence: Synthetic peptide
  Seed: RVLAMAIY (TP53 R158L)
RTLAMAIY

SEQ ID NO: 18884 - protein, 9 aa, Artificial Sequence
  Description of Artificial Sequence: Synthetic peptide
  Seed: RVLAMAIYK (TP53 R158L)
RTLAMAIYA

SEQ ID NO: 18885 - protein, 9 aa, Artificial Sequence
  Description of Artificial Sequence: Synthetic peptide
  Seed: RVLAMAIYK (TP53 R158L)
RTLAMAIYF

SEQ ID NO: 18886 - protein, 9 aa, Artificial Sequence
  Description of Artificial Sequence: Synthetic peptide
  Seed: RVLAMAIYK (TP53 R158L)
RTLAMAIYG

SEQ ID NO: 18887 - protein, 9 aa, Artificial Sequence
  Description of Artificial Sequence: Synthetic peptide
  Seed: RVLAMAIYK (TP53 R158L)
RTLAMAIYH

SEQ ID NO: 18888 - protein, 9 aa, Artificial Sequence
  Description of Artificial Sequence: Synthetic peptide
  Seed: RVLAMAIYK (TP53 R158L)
RTLAMAIYI

SEQ ID NO: 18889 - protein, 9 aa, Artificial Sequence
  Description of Artificial Sequence: Synthetic peptide
  Seed: RVLAMAIYK (TP53 R158L)
RTLAMAIYK

SEQ ID NO: 18890 - protein, 10 aa, Artificial Sequence
  Description of Artificial Sequence: Synthetic peptide
  Seed: RVLAMAIYKQ (TP53 R158L)
RTLAMAIYKA

SEQ ID NO: 18891 - protein, 10 aa, Artificial Sequence
  Description of Artificial Sequence: Synthetic peptide
  Seed: RVLAMAIYKQ (TP53 R158L)
RTLAMAIYKC

SEQ ID NO: 18892 - protein, 10 aa, Artificial Sequence
  Description of Artificial Sequence: Synthetic peptide
  Seed: RVLAMAIYKQ (TP53 R158L)
RTLAMAIYKD

SEQ ID NO: 18893 - protein, 10 aa, Artificial Sequence
  Description of Artificial Sequence: Synthetic peptide
  Seed: RVLAMAIYKQ (TP53 R158L)
RTLAMAIYKE

SEQ ID NO: 18894 - protein, 10 aa, Artificial Sequence
  Description of Artificial Sequence: Synthetic peptide
  Seed: RVLAMAIYKQ (TP53 R158L)
RTLAMAIYKF

SEQ ID NO: 18895 - protein, 10 aa, Artificial Sequence
  Description of Artificial Sequence: Synthetic peptide
  Seed: RVLAMAIYKQ (TP53 R158L)
RTLAMAIYKG

SEQ ID NO: 18896 - protein, 10 aa, Artificial Sequence
  Description of Artificial Sequence: Synthetic peptide
  Seed: RVLAMAIYKQ (TP53 R158L)
RTLAMAIYKH

SEQ ID NO: 18897 - protein, 10 aa, Artificial Sequence
  Description of Artificial Sequence: Synthetic peptide
  Seed: RVLAMAIYKQ (TP53 R158L)
RTLAMAIYKI

SEQ ID NO: 18898 - protein, 10 aa, Artificial Sequence
  Description of Artificial Sequence: Synthetic peptide
  Seed: RVLAMAIYKQ (TP53 R158L)
RTLAMAIYKK

SEQ ID NO: 18899 - protein, 10 aa, Artificial Sequence
  Description of Artificial Sequence: Synthetic peptide
  Seed: RVLAMAIYKQ (TP53 R158L)
RTLAMAIYKL

SEQ ID NO: 18900 - protein, 10 aa, Artificial Sequence
  Description of Artificial Sequence: Synthetic peptide
  Seed: RVLAMAIYKQ (TP53 R158L)
RTLAMAIYKM

SEQ ID NO: 18901 - protein, 10 aa, Artificial Sequence
  Description of Artificial Sequence: Synthetic peptide
  Seed: RVLAMAIYKQ (TP53 R158L)
RTLAMAIYKN

SEQ ID NO: 18902 - protein, 10 aa, Artificial Sequence
  Description of Artificial Sequence: Synthetic peptide
  Seed: RVLAMAIYKQ (TP53 R158L)
RTLAMAIYKP

SEQ ID NO: 18903 - protein, 10 aa, Artificial Sequence
  Description of Artificial Sequence: Synthetic peptide
  Seed: RVLAMAIYKQ (TP53 R158L)
RTLAMAIYKQ

SEQ ID NO: 18904 - protein, 10 aa, Artificial Sequence
  Description of Artificial Sequence: Synthetic peptide
  Seed: RVLAMAIYKQ (TP53 R158L)
RTLAMAIYKR

SEQ ID NO: 18905 - protein, 10 aa, Artificial Sequence
  Description of Artificial Sequence: Synthetic peptide
  Seed: RVLAMAIYKQ (TP53 R158L)
RTLAMAIYKS

SEQ ID NO: 18906 - protein, 10 aa, Artificial Sequence
  Description of Artificial Sequence: Synthetic peptide
  Seed: RVLAMAIYKQ (TP53 R158L)
RTLAMAIYKT

SEQ ID NO: 18907 - protein, 10 aa, Artificial Sequence
  Description of Artificial Sequence: Synthetic peptide
  Seed: RVLAMAIYKQ (TP53 R158L)
RTLAMAIYKV

SEQ ID NO: 18908 - protein, 10 aa, Artificial Sequence
  Description of Artificial Sequence: Synthetic peptide
  Seed: RVLAMAIYKQ (TP53 R158L)
RTLAMAIYKW

SEQ ID NO: 18909 - protein, 10 aa, Artificial Sequence
  Description of Artificial Sequence: Synthetic peptide
  Seed: RVLAMAIYKQ (TP53 R158L)
RTLAMAIYKY

SEQ ID NO: 18910 - protein, 9 aa, Artificial Sequence
  Description of Artificial Sequence: Synthetic peptide
  Seed: RVLAMAIYK (TP53 R158L)
RTLAMAIYL

SEQ ID NO: 18911 - protein, 9 aa, Artificial Sequence
  Description of Artificial Sequence: Synthetic peptide
  Seed: RVLAMAIYK (TP53 R158L)
RTLAMAIYM

SEQ ID NO: 18912 - protein, 9 aa, Artificial Sequence
  Description of Artificial Sequence: Synthetic peptide
  Seed: RVLAMAIYK (TP53 R158L)
RTLAMAIYN

SEQ ID NO: 18913 - protein, 9 aa, Artificial Sequence
  Description of Artificial Sequence: Synthetic peptide
  Seed: RVLAMAIYK (TP53 R158L)
RTLAMAIYP

SEQ ID NO: 18914 - protein, 9 aa, Artificial Sequence
  Description of Artificial Sequence: Synthetic peptide
  Seed: RVLAMAIYK (TP53 R158L)
RTLAMAIYQ

SEQ ID NO: 18915 - protein, 9 aa, Artificial Sequence
  Description of Artificial Sequence: Synthetic peptide
  Seed: RVLAMAIYK (TP53 R158L)
RTLAMAIYS

SEQ ID NO: 18916 - protein, 9 aa, Artificial Sequence
  Description of Artificial Sequence: Synthetic peptide
  Seed: RVLAMAIYK (TP53 R158L)
RTLAMAIYT

SEQ ID NO: 18917 - protein, 9 aa, Artificial Sequence
  Description of Artificial Sequence: Synthetic peptide
  Seed: RVLAMAIYK (TP53 R158L)
RTLAMAIYV

SEQ ID NO: 18918 - protein, 8 aa, Artificial Sequence
  Description of Artificial Sequence: Synthetic peptide
  Seed: RVLAMAIY (TP53 R158L)
RVLAMAIF

SEQ ID NO: 18919 - protein, 9 aa, Artificial Sequence
  Description of Artificial Sequence: Synthetic peptide
  Seed: RVLAMAIYK (TP53 R158L)
RVLAMAIYA

SEQ ID NO: 18920 - protein, 9 aa, Artificial Sequence
  Description of Artificial Sequence: Synthetic peptide
  Seed: RVLAMAIYK (TP53 R158L)
RVLAMAIYG

SEQ ID NO: 18921 - protein, 9 aa, Artificial Sequence
  Description of Artificial Sequence: Synthetic peptide
  Seed: RVLAMAIYK (TP53 R158L)
RVLAMAIYH

SEQ ID NO: 18922 - protein, 9 aa, Artificial Sequence
  Description of Artificial Sequence: Synthetic peptide
  Seed: RVLAMAIYK (TP53 R158L)
RVLAMAIYI

SEQ ID NO: 18923 - protein, 10 aa, Artificial Sequence
  Description of Artificial Sequence: Synthetic peptide
  Seed: RVLAMAIYKQ (TP53 R158L)
RVLAMAIYKA

SEQ ID NO: 18924 - protein, 10 aa, Artificial Sequence
  Description of Artificial Sequence: Synthetic peptide
  Seed: RVLAMAIYKQ (TP53 R158L)
RVLAMAIYKC

SEQ ID NO: 18925 - protein, 10 aa, Artificial Sequence
  Description of Artificial Sequence: Synthetic peptide
  Seed: RVLAMAIYKQ (TP53 R158L)
RVLAMAIYKD

SEQ ID NO: 18926 - protein, 10 aa, Artificial Sequence
  Description of Artificial Sequence: Synthetic peptide
  Seed: RVLAMAIYKQ (TP53 R158L)
RVLAMAIYKE

SEQ ID NO: 18927 - protein, 10 aa, Artificial Sequence
  Description of Artificial Sequence: Synthetic peptide
  Seed: RVLAMAIYKQ (TP53 R158L)
RVLAMAIYKF

SEQ ID NO: 18928 - protein, 10 aa, Artificial Sequence
  Description of Artificial Sequence: Synthetic peptide
  Seed: RVLAMAIYKQ (TP53 R158L)
RVLAMAIYKG

SEQ ID NO: 18929 - protein, 10 aa, Artificial Sequence
  Description of Artificial Sequence: Synthetic peptide
  Seed: RVLAMAIYKQ (TP53 R158L)
RVLAMAIYKH

SEQ ID NO: 18930 - protein, 10 aa, Artificial Sequence
  Description of Artificial Sequence: Synthetic peptide
  Seed: RVLAMAIYKQ (TP53 R158L)
RVLAMAIYKI

SEQ ID NO: 18931 - protein, 10 aa, Artificial Sequence
  Description of Artificial Sequence: Synthetic peptide
  Seed: RVLAMAIYKQ (TP53 R158L)
RVLAMAIYKK

SEQ ID NO: 18932 - protein, 10 aa, Artificial Sequence
  Description of Artificial Sequence: Synthetic peptide
  Seed: RVLAMAIYKQ (TP53 R158L)
RVLAMAIYKL

SEQ ID NO: 18933 - protein, 10 aa, Artificial Sequence
  Description of Artificial Sequence: Synthetic peptide
  Seed: RVLAMAIYKQ (TP53 R158L)
RVLAMAIYKM

SEQ ID NO: 18934 - protein, 10 aa, Artificial Sequence
  Description of Artificial Sequence: Synthetic peptide
  Seed: RVLAMAIYKQ (TP53 R158L)
RVLAMAIYKN

SEQ ID NO: 18935 - protein, 10 aa, Artificial Sequence
  Description of Artificial Sequence: Synthetic peptide
  Seed: RVLAMAIYKQ (TP53 R158L)
RVLAMAIYKP

SEQ ID NO: 18936 - protein, 10 aa, Artificial Sequence
  Description of Artificial Sequence: Synthetic peptide
  Seed: RVLAMAIYKQ (TP53 R158L)
RVLAMAIYKR

SEQ ID NO: 18937 - protein, 10 aa, Artificial Sequence
  Description of Artificial Sequence: Synthetic peptide
  Seed: RVLAMAIYKQ (TP53 R158L)
RVLAMAIYKS

SEQ ID NO: 18938 - protein, 10 aa, Artificial Sequence
  Description of Artificial Sequence: Synthetic peptide
  Seed: RVLAMAIYKQ (TP53 R158L)
RVLAMAIYKT

SEQ ID NO: 18939 - protein, 10 aa, Artificial Sequence
  Description of Artificial Sequence: Synthetic peptide
  Seed: RVLAMAIYKQ (TP53 R158L)
RVLAMAIYKV

SEQ ID NO: 18940 - protein, 10 aa, Artificial Sequence
  Description of Artificial Sequence: Synthetic peptide
  Seed: RVLAMAIYKQ (TP53 R158L)
RVLAMAIYKW

SEQ ID NO: 18941 - protein, 10 aa, Artificial Sequence
  Description of Artificial Sequence: Synthetic peptide
  Seed: RVLAMAIYKQ (TP53 R158L)
RVLAMAIYKY

SEQ ID NO: 18942 - protein, 9 aa, Artificial Sequence
  Description of Artificial Sequence: Synthetic peptide
  Seed: RVLAMAIYK (TP53 R158L)
RVLAMAIYL

SEQ ID NO: 18943 - protein, 9 aa, Artificial Sequence
  Description of Artificial Sequence: Synthetic peptide
  Seed: RVLAMAIYK (TP53 R158L)
RVLAMAIYM

SEQ ID NO: 18944 - protein, 9 aa, Artificial Sequence
  Description of Artificial Sequence: Synthetic peptide
  Seed: RVLAMAIYK (TP53 R158L)
RVLAMAIYR

SEQ ID NO: 18945 - protein, 9 aa, Artificial Sequence
  Description of Artificial Sequence: Synthetic peptide
  Seed: RVLAMAIYK (TP53 R158L)
RVLAMAIYS

SEQ ID NO: 18946 - protein, 9 aa, Artificial Sequence
  Description of Artificial Sequence: Synthetic peptide
  Seed: RVLAMAIYK (TP53 R158L)
RVLAMAIYT

SEQ ID NO: 18947 - protein, 9 aa, Artificial Sequence
  Description of Artificial Sequence: Synthetic peptide
  Seed: RVLAMAIYK (TP53 R158L)
RVLAMAIYV

SEQ ID NO: 18948 - protein, 9 aa, Artificial Sequence
  Description of Artificial Sequence: Synthetic peptide
  Seed: RVLAMAIYK (TP53 R158L)
RVLAMAIYY

SEQ ID NO: 18949 - protein, 8 aa, Artificial Sequence
  Description of Artificial Sequence: Synthetic peptide
  Seed: RVLAMAIY (TP53 R158L)
RWLAMAIY

SEQ ID NO: 18950 - protein, 9 aa, Artificial Sequence
  Description of Artificial Sequence: Synthetic peptide
  Seed: RVLAMAIYK (TP53 R158L)
RWLAMAIYA

SEQ ID NO: 18951 - protein, 9 aa, Artificial Sequence
  Description of Artificial Sequence: Synthetic peptide
  Seed: RVLAMAIYK (TP53 R158L)
RWLAMAIYH

SEQ ID NO: 18952 - protein, 9 aa, Artificial Sequence
  Description of Artificial Sequence: Synthetic peptide
  Seed: RVLAMAIYK (TP53 R158L)
RWLAMAIYI

SEQ ID NO: 18953 - protein, 9 aa, Artificial Sequence
  Description of Artificial Sequence: Synthetic peptide
  Seed: RVLAMAIYK (TP53 R158L)
RWLAMAIYK

SEQ ID NO: 18954 - protein, 10 aa, Artificial Sequence
  Description of Artificial Sequence: Synthetic peptide
  Seed: RVLAMAIYKQ (TP53 R158L)
RWLAMAIYKA

SEQ ID NO: 18955 - protein, 10 aa, Artificial Sequence
  Description of Artificial Sequence: Synthetic peptide
  Seed: RVLAMAIYKQ (TP53 R158L)
RWLAMAIYKC

SEQ ID NO: 18956 - protein, 10 aa, Artificial Sequence
  Description of Artificial Sequence: Synthetic peptide
  Seed: RVLAMAIYKQ (TP53 R158L)
RWLAMAIYKD

SEQ ID NO: 18957 - protein, 10 aa, Artificial Sequence
  Description of Artificial Sequence: Synthetic peptide
  Seed: RVLAMAIYKQ (TP53 R158L)
RWLAMAIYKE

SEQ ID NO: 18958 - protein, 10 aa, Artificial Sequence
  Description of Artificial Sequence: Synthetic peptide
  Seed: RVLAMAIYKQ (TP53 R158L)
RWLAMAIYKF

SEQ ID NO: 18959 - protein, 10 aa, Artificial Sequence
  Description of Artificial Sequence: Synthetic peptide
  Seed: RVLAMAIYKQ (TP53 R158L)
RWLAMAIYKG

SEQ ID NO: 18960 - protein, 10 aa, Artificial Sequence
  Description of Artificial Sequence: Synthetic peptide
  Seed: RVLAMAIYKQ (TP53 R158L)
RWLAMAIYKH

SEQ ID NO: 18961 - protein, 10 aa, Artificial Sequence
  Description of Artificial Sequence: Synthetic peptide
  Seed: RVLAMAIYKQ (TP53 R158L)
RWLAMAIYKI

SEQ ID NO: 18962 - protein, 10 aa, Artificial Sequence
  Description of Artificial Sequence: Synthetic peptide
  Seed: RVLAMAIYKQ (TP53 R158L)
RWLAMAIYKK

SEQ ID NO: 18963 - protein, 10 aa, Artificial Sequence
  Description of Artificial Sequence: Synthetic peptide
  Seed: RVLAMAIYKQ (TP53 R158L)
RWLAMAIYKL

SEQ ID NO: 18964 - protein, 10 aa, Artificial Sequence
  Description of Artificial Sequence: Synthetic peptide
  Seed: RVLAMAIYKQ (TP53 R158L)
RWLAMAIYKM

SEQ ID NO: 18965 - protein, 10 aa, Artificial Sequence
  Description of Artificial Sequence: Synthetic peptide
  Seed: RVLAMAIYKQ (TP53 R158L)
RWLAMAIYKN

SEQ ID NO: 18966 - protein, 10 aa, Artificial Sequence
  Description of Artificial Sequence: Synthetic peptide
  Seed: RVLAMAIYKQ (TP53 R158L)
RWLAMAIYKP

SEQ ID NO: 18967 - protein, 10 aa, Artificial Sequence
  Description of Artificial Sequence: Synthetic peptide
  Seed: RVLAMAIYKQ (TP53 R158L)
RWLAMAIYKQ

SEQ ID NO: 18968 - protein, 10 aa, Artificial Sequence
  Description of Artificial Sequence: Synthetic peptide
  Seed: RVLAMAIYKQ (TP53 R158L)
RWLAMAIYKR

SEQ ID NO: 18969 - protein, 10 aa, Artificial Sequence
  Description of Artificial Sequence: Synthetic peptide
  Seed: RVLAMAIYKQ (TP53 R158L)
RWLAMAIYKS

SEQ ID NO: 18970 - protein, 10 aa, Artificial Sequence
  Description of Artificial Sequence: Synthetic peptide
  Seed: RVLAMAIYKQ (TP53 R158L)
RWLAMAIYKT

SEQ ID NO: 18971 - protein, 10 aa, Artificial Sequence
  Description of Artificial Sequence: Synthetic peptide
  Seed: RVLAMAIYKQ (TP53 R158L)
RWLAMAIYKV

SEQ ID NO: 18972 - protein, 10 aa, Artificial Sequence
  Description of Artificial Sequence: Synthetic peptide
  Seed: RVLAMAIYKQ (TP53 R158L)
RWLAMAIYKW

SEQ ID NO: 18973 - protein, 10 aa, Artificial Sequence
  Description of Artificial Sequence: Synthetic peptide
  Seed: RVLAMAIYKQ (TP53 R158L)
RWLAMAIYKY

SEQ ID NO: 18974 - protein, 9 aa, Artificial Sequence
  Description of Artificial Sequence: Synthetic peptide
  Seed: RVLAMAIYK (TP53 R158L)
RWLAMAIYL

SEQ ID NO: 18975 - protein, 9 aa, Artificial Sequence
  Description of Artificial Sequence: Synthetic peptide
  Seed: RVLAMAIYK (TP53 R158L)
RWLAMAIYM

SEQ ID NO: 18976 - protein, 9 aa, Artificial Sequence
  Description of Artificial Sequence: Synthetic peptide
  Seed: RVLAMAIYK (TP53 R158L)
RWLAMAIYQ

SEQ ID NO: 18977 - protein, 9 aa, Artificial Sequence
  Description of Artificial Sequence: Synthetic peptide
  Seed: RVLAMAIYK (TP53 R158L)
RWLAMAIYR

SEQ ID NO: 18978 - protein, 9 aa, Artificial Sequence
  Description of Artificial Sequence: Synthetic peptide
  Seed: RVLAMAIYK (TP53 R158L)
RWLAMAIYV

SEQ ID NO: 18979 - protein, 9 aa, Artificial Sequence
  Description of Artificial Sequence: Synthetic peptide
  Seed: RVLAMAIYK (TP53 R158L)
RWLAMAIYY

SEQ ID NO: 18980 - protein, 8 aa, Artificial Sequence
  Description of Artificial Sequence: Synthetic peptide
  Seed: RVLAMAIY (TP53 R158L)
RYLAMAIY

SEQ ID NO: 18981 - protein, 9 aa, Artificial Sequence
  Description of Artificial Sequence: Synthetic peptide
  Seed: RVLAMAIYK (TP53 R158L)
RYLAMAIYA

SEQ ID NO: 18982 - protein, 9 aa, Artificial Sequence
  Description of Artificial Sequence: Synthetic peptide
  Seed: RVLAMAIYK (TP53 R158L)
RYLAMAIYG

SEQ ID NO: 18983 - protein, 9 aa, Artificial Sequence
  Description of Artificial Sequence: Synthetic peptide
  Seed: RVLAMAIYK (TP53 R158L)
RYLAMAIYH

SEQ ID NO: 18984 - protein, 9 aa, Artificial Sequence
  Description of Artificial Sequence: Synthetic peptide
  Seed: RVLAMAIYK (TP53 R158L)
RYLAMAIYI

SEQ ID NO: 18985 - protein, 9 aa, Artificial Sequence
  Description of Artificial Sequence: Synthetic peptide
  Seed: RVLAMAIYK (TP53 R158L)
RYLAMAIYK

SEQ ID NO: 18986 - protein, 10 aa, Artificial Sequence
  Description of Artificial Sequence: Synthetic peptide
  Seed: RVLAMAIYKQ (TP53 R158L)
RYLAMAIYKA

SEQ ID NO: 18987 - protein, 10 aa, Artificial Sequence
  Description of Artificial Sequence: Synthetic peptide
  Seed: RVLAMAIYKQ (TP53 R158L)
RYLAMAIYKC

SEQ ID NO: 18988 - protein, 10 aa, Artificial Sequence
  Description of Artificial Sequence: Synthetic peptide
  Seed: RVLAMAIYKQ (TP53 R158L)
RYLAMAIYKD

SEQ ID NO: 18989 - protein, 10 aa, Artificial Sequence
  Description of Artificial Sequence: Synthetic peptide
  Seed: RVLAMAIYKQ (TP53 R158L)
RYLAMAIYKE

SEQ ID NO: 18990 - protein, 10 aa, Artificial Sequence
  Description of Artificial Sequence: Synthetic peptide
  Seed: RVLAMAIYKQ (TP53 R158L)
RYLAMAIYKF

SEQ ID NO: 18991 - protein, 10 aa, Artificial Sequence
  Description of Artificial Sequence: Synthetic peptide
  Seed: RVLAMAIYKQ (TP53 R158L)
RYLAMAIYKG

SEQ ID NO: 18992 - protein, 10 aa, Artificial Sequence
  Description of Artificial Sequence: Synthetic peptide
  Seed: RVLAMAIYKQ (TP53 R158L)
RYLAMAIYKH

SEQ ID NO: 18993 - protein, 10 aa, Artificial Sequence
  Description of Artificial Sequence: Synthetic peptide
  Seed: RVLAMAIYKQ (TP53 R158L)
RYLAMAIYKI

SEQ ID NO: 18994 - protein, 10 aa, Artificial Sequence
  Description of Artificial Sequence: Synthetic peptide
  Seed: RVLAMAIYKQ (TP53 R158L)
RYLAMAIYKK

SEQ ID NO: 18995 - protein, 10 aa, Artificial Sequence
  Description of Artificial Sequence: Synthetic peptide
  Seed: RVLAMAIYKQ (TP53 R158L)
RYLAMAIYKL

SEQ ID NO: 18996 - protein, 10 aa, Artificial Sequence
  Description of Artificial Sequence: Synthetic peptide
  Seed: RVLAMAIYKQ (TP53 R158L)
RYLAMAIYKM

SEQ ID NO: 18997 - protein, 10 aa, Artificial Sequence
  Description of Artificial Sequence: Synthetic peptide
  Seed: RVLAMAIYKQ (TP53 R158L)
RYLAMAIYKN

SEQ ID NO: 18998 - protein, 10 aa, Artificial Sequence
  Description of Artificial Sequence: Synthetic peptide
  Seed: RVLAMAIYKQ (TP53 R158L)
RYLAMAIYKP

SEQ ID NO: 18999 - protein, 10 aa, Artificial Sequence
  Description of Artificial Sequence: Synthetic peptide
  Seed: RVLAMAIYKQ (TP53 R158L)
RYLAMAIYKQ

SEQ ID NO: 19000 - protein, 10 aa, Artificial Sequence
  Description of Artificial Sequence: Synthetic peptide
  Seed: RVLAMAIYKQ (TP53 R158L)
RYLAMAIYKR

SEQ ID NO: 19001 - protein, 10 aa, Artificial Sequence
  Description of Artificial Sequence: Synthetic peptide
  Seed: RVLAMAIYKQ (TP53 R158L)
RYLAMAIYKS

SEQ ID NO: 19002 - protein, 10 aa, Artificial Sequence
  Description of Artificial Sequence: Synthetic peptide
  Seed: RVLAMAIYKQ (TP53 R158L)
RYLAMAIYKT

SEQ ID NO: 19003 - protein, 10 aa, Artificial Sequence
  Description of Artificial Sequence: Synthetic peptide
  Seed: RVLAMAIYKQ (TP53 R158L)
RYLAMAIYKV

SEQ ID NO: 19004 - protein, 10 aa, Artificial Sequence
  Description of Artificial Sequence: Synthetic peptide
  Seed: RVLAMAIYKQ (TP53 R158L)
RYLAMAIYKW

SEQ ID NO: 19005 - protein, 10 aa, Artificial Sequence
  Description of Artificial Sequence: Synthetic peptide
  Seed: RVLAMAIYKQ (TP53 R158L)
RYLAMAIYKY

SEQ ID NO: 19006 - protein, 9 aa, Artificial Sequence
  Description of Artificial Sequence: Synthetic peptide
  Seed: RVLAMAIYK (TP53 R158L)
RYLAMAIYL

SEQ ID NO: 19007 - protein, 9 aa, Artificial Sequence
  Description of Artificial Sequence: Synthetic peptide
  Seed: RVLAMAIYK (TP53 R158L)
RYLAMAIYM

SEQ ID NO: 19008 - protein, 9 aa, Artificial Sequence
  Description of Artificial Sequence: Synthetic peptide
  Seed: RVLAMAIYK (TP53 R158L)
RYLAMAIYR

SEQ ID NO: 19009 - protein, 9 aa, Artificial Sequence
  Description of Artificial Sequence: Synthetic peptide
  Seed: RVLAMAIYK (TP53 R158L)
RYLAMAIYS

SEQ ID NO: 19010 - protein, 9 aa, Artificial Sequence
  Description of Artificial Sequence: Synthetic peptide
  Seed: RVLAMAIYK (TP53 R158L)
RYLAMAIYV

SEQ ID NO: 19011 - protein, 11 aa, Artificial Sequence
  Description of Artificial Sequence: Synthetic peptide
  Seed: TPPPGTRVLAM (TP53 R158L)
TAPPGTRVLAM

SEQ ID NO: 19012 - protein, 9 aa, Artificial Sequence
  Description of Artificial Sequence: Synthetic peptide
  Seed: TRVLAMAIY (TP53 R158L)
TAVLAMAIF

SEQ ID NO: 19013 - protein, 9 aa, Artificial Sequence
  Description of Artificial Sequence: Synthetic peptide
  Seed: TRVLAMAIY (TP53 R158L)
TAVLAMAIM

SEQ ID NO: 19014 - protein, 9 aa, Artificial Sequence
  Description of Artificial Sequence: Synthetic peptide
  Seed: TRVLAMAIY (TP53 R158L)
TAVLAMAIY

SEQ ID NO: 19015 - protein, 10 aa, Artificial Sequence
  Description of Artificial Sequence: Synthetic peptide
  Seed: TRVLAMAIYK (TP53 R158L)
TAVLAMAIYK

SEQ ID NO: 19016 - protein, 10 aa, Artificial Sequence
  Description of Artificial Sequence: Synthetic peptide
  Seed: TRVLAMAIYK (TP53 R158L)
TAVLAMAIYR

SEQ ID NO: 19017 - protein, 10 aa, Artificial Sequence
  Description of Artificial Sequence: Synthetic peptide
  Seed: TRVLAMAIYK (TP53 R158L)
TAVLAMAIYY

SEQ ID NO: 19018 - protein, 11 aa, Artificial Sequence
  Description of Artificial Sequence: Synthetic peptide
  Seed: TPPPGTRVLAM (TP53 R158L)
TCPPGTRVLAL

SEQ ID NO: 19019 - protein, 11 aa, Artificial Sequence
  Description of Artificial Sequence: Synthetic peptide
  Seed: TPPPGTRVLAM (TP53 R158L)
TCPPGTRVLAM

SEQ ID NO: 19020 - protein, 10 aa, Artificial Sequence
  Description of Artificial Sequence: Synthetic peptide
  Seed: TRVLAMAIYK (TP53 R158L)
TCVLAMAIYK

SEQ ID NO: 19021 - protein, 10 aa, Artificial Sequence
  Description of Artificial Sequence: Synthetic peptide
  Seed: TRVLAMAIYK (TP53 R158L)
TCVLAMAIYR

SEQ ID NO: 19022 - protein, 10 aa, Artificial Sequence
  Description of Artificial Sequence: Synthetic peptide
  Seed: TRVLAMAIYK (TP53 R158L)
TCVLAMAIYY

SEQ ID NO: 19023 - protein, 11 aa, Artificial Sequence
  Description of Artificial Sequence: Synthetic peptide
  Seed: TPPPGTRVLAM (TP53 R158L)
TDPPGTRVLAL

SEQ ID NO: 19024 - protein, 11 aa, Artificial Sequence
  Description of Artificial Sequence: Synthetic peptide
  Seed: TPPPGTRVLAM (TP53 R158L)
TDPPGTRVLAM

SEQ ID NO: 19025 - protein, 10 aa, Artificial Sequence
  Description of Artificial Sequence: Synthetic peptide
  Seed: TRVLAMAIYK (TP53 R158L)
TDVLAMAIYK

SEQ ID NO: 19026 - protein, 10 aa, Artificial Sequence
  Description of Artificial Sequence: Synthetic peptide
  Seed: TRVLAMAIYK (TP53 R158L)
TDVLAMAIYR

SEQ ID NO: 19027 - protein, 10 aa, Artificial Sequence
  Description of Artificial Sequence: Synthetic peptide
  Seed: TRVLAMAIYK (TP53 R158L)
TDVLAMAIYY

SEQ ID NO: 19028 - protein, 11 aa, Artificial Sequence
  Description of Artificial Sequence: Synthetic peptide
  Seed: TPPPGTRVLAM (TP53 R158L)
TEPPGTRVLAL

SEQ ID NO: 19029 - protein, 11 aa, Artificial Sequence
  Description of Artificial Sequence: Synthetic peptide
  Seed: TPPPGTRVLAM (TP53 R158L)
TEPPGTRVLAM

SEQ ID NO: 19030 - protein, 9 aa, Artificial Sequence
  Description of Artificial Sequence: Synthetic peptide
  Seed: TRVLAMAIY (TP53 R158L)
TEVLAMAIF

SEQ ID NO: 19031 - protein, 9 aa, Artificial Sequence
  Description of Artificial Sequence: Synthetic peptide
  Seed: TRVLAMAIY (TP53 R158L)
TEVLAMAIM

SEQ ID NO: 19032 - protein, 9 aa, Artificial Sequence
  Description of Artificial Sequence: Synthetic peptide
  Seed: TRVLAMAIY (TP53 R158L)
TEVLAMAIY

SEQ ID NO: 19033 - protein, 10 aa, Artificial Sequence
  Description of Artificial Sequence: Synthetic peptide
  Seed: TRVLAMAIYK (TP53 R158L)
TEVLAMAIYK

SEQ ID NO: 19034 - protein, 10 aa, Artificial Sequence
  Description of Artificial Sequence: Synthetic peptide
  Seed: TRVLAMAIYK (TP53 R158L)
TEVLAMAIYR

SEQ ID NO: 19035 - protein, 10 aa, Artificial Sequence
  Description of Artificial Sequence: Synthetic peptide
  Seed: TRVLAMAIYK (TP53 R158L)
TEVLAMAIYY

SEQ ID NO: 19036 - protein, 11 aa, Artificial Sequence
  Description of Artificial Sequence: Synthetic peptide
  Seed: TPPPGTRVLAM (TP53 R158L)
TFPPGTRVLAL

SEQ ID NO: 19037 - protein, 11 aa, Artificial Sequence
  Description of Artificial Sequence: Synthetic peptide
  Seed: TPPPGTRVLAM (TP53 R158L)
TFPPGTRVLAM

SEQ ID NO: 19038 - protein, 10 aa, Artificial Sequence
  Description of Artificial Sequence: Synthetic peptide
  Seed: TRVLAMAIYK (TP53 R158L)
TFVLAMAIYK

SEQ ID NO: 19039 - protein, 10 aa, Artificial Sequence
  Description of Artificial Sequence: Synthetic peptide
  Seed: TRVLAMAIYK (TP53 R158L)
TFVLAMAIYR

SEQ ID NO: 19040 - protein, 10 aa, Artificial Sequence
  Description of Artificial Sequence: Synthetic peptide
  Seed: TRVLAMAIYK (TP53 R158L)
TFVLAMAIYY

SEQ ID NO: 19041 - protein, 11 aa, Artificial Sequence
  Description of Artificial Sequence: Synthetic peptide
  Seed: TPPPGTRVLAM (TP53 R158L)
TGPPGTRVLAL

SEQ ID NO: 19042 - protein, 11 aa, Artificial Sequence
  Description of Artificial Sequence: Synthetic peptide
  Seed: TPPPGTRVLAM (TP53 R158L)
TGPPGTRVLAM

SEQ ID NO: 19043 - protein, 9 aa, Artificial Sequence
  Description of Artificial Sequence: Synthetic peptide
  Seed: TRVLAMAIY (TP53 R158L)
TGVLAMAIF

SEQ ID NO: 19044 - protein, 9 aa, Artificial Sequence
  Description of Artificial Sequence: Synthetic peptide
  Seed: TRVLAMAIY (TP53 R158L)
TGVLAMAIY

SEQ ID NO: 19045 - protein, 10 aa, Artificial Sequence
  Description of Artificial Sequence: Synthetic peptide
  Seed: TRVLAMAIYK (TP53 R158L)
TGVLAMAIYK

SEQ ID NO: 19046 - protein, 10 aa, Artificial Sequence
  Description of Artificial Sequence: Synthetic peptide
  Seed: TRVLAMAIYK (TP53 R158L)
TGVLAMAIYR

SEQ ID NO: 19047 - protein, 10 aa, Artificial Sequence
  Description of Artificial Sequence: Synthetic peptide
  Seed: TRVLAMAIYK (TP53 R158L)
TGVLAMAIYY

SEQ ID NO: 19048 - protein, 11 aa, Artificial Sequence
  Description of Artificial Sequence: Synthetic peptide
  Seed: TPPPGTRVLAM (TP53 R158L)
THPPGTRVLAL

SEQ ID NO: 19049 - protein, 11 aa, Artificial Sequence
  Description of Artificial Sequence: Synthetic peptide
  Seed: TPPPGTRVLAM (TP53 R158L)
THPPGTRVLAM

SEQ ID NO: 19050 - protein, 9 aa, Artificial Sequence
  Description of Artificial Sequence: Synthetic peptide
  Seed: TRVLAMAIY (TP53 R158L)
THVLAMAIF

SEQ ID NO: 19051 - protein, 9 aa, Artificial Sequence
  Description of Artificial Sequence: Synthetic peptide
  Seed: TRVLAMAIY (TP53 R158L)
THVLAMAIM

SEQ ID NO: 19052 - protein, 9 aa, Artificial Sequence
  Description of Artificial Sequence: Synthetic peptide
  Seed: TRVLAMAIY (TP53 R158L)
THVLAMAIY

SEQ ID NO: 19053 - protein, 10 aa, Artificial Sequence
  Description of Artificial Sequence: Synthetic peptide
  Seed: TRVLAMAIYK (TP53 R158L)
THVLAMAIYK

SEQ ID NO: 19054 - protein, 10 aa, Artificial Sequence
  Description of Artificial Sequence: Synthetic peptide
  Seed: TRVLAMAIYK (TP53 R158L)
THVLAMAIYR

SEQ ID NO: 19055 - protein, 10 aa, Artificial Sequence
  Description of Artificial Sequence: Synthetic peptide
  Seed: TRVLAMAIYK (TP53 R158L)
THVLAMAIYY

SEQ ID NO: 19056 - protein, 11 aa, Artificial Sequence
  Description of Artificial Sequence: Synthetic peptide
  Seed: TPPPGTRVLAM (TP53 R158L)
TIPPGTRVLAL

SEQ ID NO: 19057 - protein, 11 aa, Artificial Sequence
  Description of Artificial Sequence: Synthetic peptide
  Seed: TPPPGTRVLAM (TP53 R158L)
TIPPGTRVLAM

SEQ ID NO: 19058 - protein, 9 aa, Artificial Sequence
  Description of Artificial Sequence: Synthetic peptide
  Seed: TRVLAMAIY (TP53 R158L)
TIVLAMAIF

SEQ ID NO: 19059 - protein, 9 aa, Artificial Sequence
  Description of Artificial Sequence: Synthetic peptide
  Seed: TRVLAMAIY (TP53 R158L)
TIVLAMAIY

SEQ ID NO: 19060 - protein, 10 aa, Artificial Sequence
  Description of Artificial Sequence: Synthetic peptide
  Seed: TRVLAMAIYK (TP53 R158L)
TIVLAMAIYK

SEQ ID NO: 19061 - protein, 10 aa, Artificial Sequence
  Description of Artificial Sequence: Synthetic peptide
  Seed: TRVLAMAIYK (TP53 R158L)
TIVLAMAIYR

SEQ ID NO: 19062 - protein, 10 aa, Artificial Sequence
  Description of Artificial Sequence: Synthetic peptide
  Seed: TRVLAMAIYK (TP53 R158L)
TIVLAMAIYY

SEQ ID NO: 19063 - protein, 11 aa, Artificial Sequence
  Description of Artificial Sequence: Synthetic peptide
  Seed: TPPPGTRVLAM (TP53 R158L)
TKPPGTRVLAL

SEQ ID NO: 19064 - protein, 11 aa, Artificial Sequence
  Description of Artificial Sequence: Synthetic peptide
  Seed: TPPPGTRVLAM (TP53 R158L)
TKPPGTRVLAM

SEQ ID NO: 19065 - protein, 9 aa, Artificial Sequence
  Description of Artificial Sequence: Synthetic peptide
  Seed: TRVLAMAIY (TP53 R158L)
TKVLAMAIF

SEQ ID NO: 19066 - protein, 9 aa, Artificial Sequence
  Description of Artificial Sequence: Synthetic peptide
  Seed: TRVLAMAIY (TP53 R158L)
TKVLAMAII

SEQ ID NO: 19067 - protein, 9 aa, Artificial Sequence
  Description of Artificial Sequence: Synthetic peptide
  Seed: TRVLAMAIY (TP53 R158L)
TKVLAMAIL

SEQ ID NO: 19068 - protein, 9 aa, Artificial Sequence
  Description of Artificial Sequence: Synthetic peptide
  Seed: TRVLAMAIY (TP53 R158L)
TKVLAMAIM

SEQ ID NO: 19069 - protein, 9 aa, Artificial Sequence
  Description of Artificial Sequence: Synthetic peptide
  Seed: TRVLAMAIY (TP53 R158L)
TKVLAMAIY

SEQ ID NO: 19070 - protein, 10 aa, Artificial Sequence
  Description of Artificial Sequence: Synthetic peptide
  Seed: TRVLAMAIYK (TP53 R158L)
TKVLAMAIYK

SEQ ID NO: 19071 - protein, 10 aa, Artificial Sequence
  Description of Artificial Sequence: Synthetic peptide
  Seed: TRVLAMAIYK (TP53 R158L)
TKVLAMAIYR

SEQ ID NO: 19072 - protein, 10 aa, Artificial Sequence
  Description of Artificial Sequence: Synthetic peptide
  Seed: TRVLAMAIYK (TP53 R158L)
TKVLAMAIYY

SEQ ID NO: 19073 - protein, 11 aa, Artificial Sequence
  Description of Artificial Sequence: Synthetic peptide
  Seed: TPPPGTRVLAM (TP53 R158L)
TLPPGTRVLAL

SEQ ID NO: 19074 - protein, 11 aa, Artificial Sequence
  Description of Artificial Sequence: Synthetic peptide
  Seed: TPPPGTRVLAM (TP53 R158L)
TLPPGTRVLAM

SEQ ID NO: 19075 - protein, 9 aa, Artificial Sequence
  Description of Artificial Sequence: Synthetic peptide
  Seed: TRVLAMAIY (TP53 R158L)
TLVLAMAIF

SEQ ID NO: 19076 - protein, 9 aa, Artificial Sequence
  Description of Artificial Sequence: Synthetic peptide
  Seed: TRVLAMAIY (TP53 R158L)
TLVLAMAIM

SEQ ID NO: 19077 - protein, 9 aa, Artificial Sequence
  Description of Artificial Sequence: Synthetic peptide
  Seed: TRVLAMAIY (TP53 R158L)
TLVLAMAIY

SEQ ID NO: 19078 - protein, 10 aa, Artificial Sequence
  Description of Artificial Sequence: Synthetic peptide
  Seed: TRVLAMAIYK (TP53 R158L)
TLVLAMAIYK

SEQ ID NO: 19079 - protein, 10 aa, Artificial Sequence
  Description of Artificial Sequence: Synthetic peptide
  Seed: TRVLAMAIYK (TP53 R158L)
TLVLAMAIYR

SEQ ID NO: 19080 - protein, 10 aa, Artificial Sequence
  Description of Artificial Sequence: Synthetic peptide
  Seed: TRVLAMAIYK (TP53 R158L)
TLVLAMAIYY

SEQ ID NO: 19081 - protein, 11 aa, Artificial Sequence
  Description of Artificial Sequence: Synthetic peptide
  Seed: TPPPGTRVLAM (TP53 R158L)
TMPPGTRVLAL

SEQ ID NO: 19082 - protein, 11 aa, Artificial Sequence
  Description of Artificial Sequence: Synthetic peptide
  Seed: TPPPGTRVLAM (TP53 R158L)
TMPPGTRVLAM

SEQ ID NO: 19083 - protein, 9 aa, Artificial Sequence
  Description of Artificial Sequence: Synthetic peptide
  Seed: TRVLAMAIY (TP53 R158L)
TMVLAMAIF

SEQ ID NO: 19084 - protein, 9 aa, Artificial Sequence
  Description of Artificial Sequence: Synthetic peptide
  Seed: TRVLAMAIY (TP53 R158L)
TMVLAMAIH

SEQ ID NO: 19085 - protein, 9 aa, Artificial Sequence
  Description of Artificial Sequence: Synthetic peptide
  Seed: TRVLAMAIY (TP53 R158L)
TMVLAMAIL

SEQ ID NO: 19086 - protein, 9 aa, Artificial Sequence
  Description of Artificial Sequence: Synthetic peptide
  Seed: TRVLAMAIY (TP53 R158L)
TMVLAMAIM

SEQ ID NO: 19087 - protein, 9 aa, Artificial Sequence
  Description of Artificial Sequence: Synthetic peptide
  Seed: TRVLAMAIY (TP53 R158L)
TMVLAMAIY

SEQ ID NO: 19088 - protein, 10 aa, Artificial Sequence
  Description of Artificial Sequence: Synthetic peptide
  Seed: TRVLAMAIYK (TP53 R158L)
TMVLAMAIYR

SEQ ID NO: 19089 - protein, 10 aa, Artificial Sequence
  Description of Artificial Sequence: Synthetic peptide
  Seed: TRVLAMAIYK (TP53 R158L)
TMVLAMAIYY

SEQ ID NO: 19090 - protein, 11 aa, Artificial Sequence
  Description of Artificial Sequence: Synthetic peptide
  Seed: TPPPGTRVLAM (TP53 R158L)
TNPPGTRVLAL

SEQ ID NO: 19091 - protein, 11 aa, Artificial Sequence
  Description of Artificial Sequence: Synthetic peptide
  Seed: TPPPGTRVLAM (TP53 R158L)
TNPPGTRVLAM

SEQ ID NO: 19092 - protein, 9 aa, Artificial Sequence
  Description of Artificial Sequence: Synthetic peptide
  Seed: TRVLAMAIY (TP53 R158L)
TNVLAMAIF

SEQ ID NO: 19093 - protein, 9 aa, Artificial Sequence
  Description of Artificial Sequence: Synthetic peptide
  Seed: TRVLAMAIY (TP53 R158L)
TNVLAMAIY

SEQ ID NO: 19094 - protein, 10 aa, Artificial Sequence
  Description of Artificial Sequence: Synthetic peptide
  Seed: TRVLAMAIYK (TP53 R158L)
TNVLAMAIYK

SEQ ID NO: 19095 - protein, 10 aa, Artificial Sequence
  Description of Artificial Sequence: Synthetic peptide
  Seed: TRVLAMAIYK (TP53 R158L)
TNVLAMAIYR

SEQ ID NO: 19096 - protein, 10 aa, Artificial Sequence
  Description of Artificial Sequence: Synthetic peptide
  Seed: TRVLAMAIYK (TP53 R158L)
TNVLAMAIYY

SEQ ID NO: 19097 - protein, 11 aa, Artificial Sequence
  Description of Artificial Sequence: Synthetic peptide
  Seed: TPPPGTRVLAM (TP53 R158L)
TPPPGTRVLAI

SEQ ID NO: 19098 - protein, 11 aa, Artificial Sequence
  Description of Artificial Sequence: Synthetic peptide
  Seed: TPPPGTRVLAM (TP53 R158L)
TPPPGTRVLAL

SEQ ID NO: 19099 - protein, 10 aa, Artificial Sequence
  Description of Artificial Sequence: Synthetic peptide
  Seed: TRVLAMAIYK (TP53 R158L)
TPVLAMAIYK

SEQ ID NO: 19100 - protein, 10 aa, Artificial Sequence
  Description of Artificial Sequence: Synthetic peptide
  Seed: TRVLAMAIYK (TP53 R158L)
TPVLAMAIYR

SEQ ID NO: 19101 - protein, 10 aa, Artificial Sequence
  Description of Artificial Sequence: Synthetic peptide
  Seed: TRVLAMAIYK (TP53 R158L)
TPVLAMAIYY

SEQ ID NO: 19102 - protein, 11 aa, Artificial Sequence
  Description of Artificial Sequence: Synthetic peptide
  Seed: TPPPGTRVLAM (TP53 R158L)
TQPPGTRVLAL

SEQ ID NO: 19103 - protein, 11 aa, Artificial Sequence
  Description of Artificial Sequence: Synthetic peptide
  Seed: TPPPGTRVLAM (TP53 R158L)
TQPPGTRVLAM

SEQ ID NO: 19104 - protein, 9 aa, Artificial Sequence
  Description of Artificial Sequence: Synthetic peptide
  Seed: TRVLAMAIY (TP53 R158L)
TQVLAMAIA

SEQ ID NO: 19105 - protein, 9 aa, Artificial Sequence
  Description of Artificial Sequence: Synthetic peptide
  Seed: TRVLAMAIY (TP53 R158L)
TQVLAMAIH

SEQ ID NO: 19106 - protein, 9 aa, Artificial Sequence
  Description of Artificial Sequence: Synthetic peptide
  Seed: TRVLAMAIY (TP53 R158L)
TQVLAMAII

SEQ ID NO: 19107 - protein, 9 aa, Artificial Sequence
  Description of Artificial Sequence: Synthetic peptide
  Seed: TRVLAMAIY (TP53 R158L)
TQVLAMAIL

SEQ ID NO: 19108 - protein, 9 aa, Artificial Sequence
  Description of Artificial Sequence: Synthetic peptide
  Seed: TRVLAMAIY (TP53 R158L)
TQVLAMAIM

SEQ ID NO: 19109 - protein, 9 aa, Artificial Sequence
  Description of Artificial Sequence: Synthetic peptide
  Seed: TRVLAMAIY (TP53 R158L)
TQVLAMAIV

SEQ ID NO: 19110 - protein, 9 aa, Artificial Sequence
  Description of Artificial Sequence: Synthetic peptide
  Seed: TRVLAMAIY (TP53 R158L)
TQVLAMAIW

SEQ ID NO: 19111 - protein, 10 aa, Artificial Sequence
  Description of Artificial Sequence: Synthetic peptide
  Seed: TRVLAMAIYK (TP53 R158L)
TQVLAMAIYK

SEQ ID NO: 19112 - protein, 10 aa, Artificial Sequence
  Description of Artificial Sequence: Synthetic peptide
  Seed: TRVLAMAIYK (TP53 R158L)
TQVLAMAIYR

SEQ ID NO: 19113 - protein, 10 aa, Artificial Sequence
  Description of Artificial Sequence: Synthetic peptide
  Seed: TRVLAMAIYK (TP53 R158L)
TQVLAMAIYY

SEQ ID NO: 19114 - protein, 11 aa, Artificial Sequence
  Description of Artificial Sequence: Synthetic peptide
  Seed: TPPPGTRVLAM (TP53 R158L)
TRPPGTRVLAL

SEQ ID NO: 19115 - protein, 11 aa, Artificial Sequence
  Description of Artificial Sequence: Synthetic peptide
  Seed: TPPPGTRVLAM (TP53 R158L)
TRPPGTRVLAM

SEQ ID NO: 19116 - protein, 9 aa, Artificial Sequence
  Description of Artificial Sequence: Synthetic peptide
  Seed: TRVLAMAIY (TP53 R158L)
TRVLAMAIF

SEQ ID NO: 19117 - protein, 9 aa, Artificial Sequence
  Description of Artificial Sequence: Synthetic peptide
  Seed: TRVLAMAIY (TP53 R158L)
TRVLAMAIM

SEQ ID NO: 19118 - protein, 10 aa, Artificial Sequence
  Description of Artificial Sequence: Synthetic peptide
  Seed: TRVLAMAIYK (TP53 R158L)
TRVLAMAIYF

SEQ ID NO: 19119 - protein, 10 aa, Artificial Sequence
  Description of Artificial Sequence: Synthetic peptide
  Seed: TRVLAMAIYK (TP53 R158L)
TRVLAMAIYI

SEQ ID NO: 19120 - protein, 10 aa, Artificial Sequence
  Description of Artificial Sequence: Synthetic peptide
  Seed: TRVLAMAIYK (TP53 R158L)
TRVLAMAIYL

SEQ ID NO: 19121 - protein, 10 aa, Artificial Sequence
  Description of Artificial Sequence: Synthetic peptide
  Seed: TRVLAMAIYK (TP53 R158L)
TRVLAMAIYM

SEQ ID NO: 19122 - protein, 10 aa, Artificial Sequence
  Description of Artificial Sequence: Synthetic peptide
  Seed: TRVLAMAIYK (TP53 R158L)
TRVLAMAIYR

SEQ ID NO: 19123 - protein, 10 aa, Artificial Sequence
  Description of Artificial Sequence: Synthetic peptide
  Seed: TRVLAMAIYK (TP53 R158L)
TRVLAMAIYV

SEQ ID NO: 19124 - protein, 10 aa, Artificial Sequence
  Description of Artificial Sequence: Synthetic peptide
  Seed: TRVLAMAIYK (TP53 R158L)
TRVLAMAIYY

SEQ ID NO: 19125 - protein, 11 aa, Artificial Sequence
  Description of Artificial Sequence: Synthetic peptide
  Seed: TPPPGTRVLAM (TP53 R158L)
TSPPGTRVLAL

SEQ ID NO: 19126 - protein, 11 aa, Artificial Sequence
  Description of Artificial Sequence: Synthetic peptide
  Seed: TPPPGTRVLAM (TP53 R158L)
TSPPGTRVLAM

SEQ ID NO: 19127 - protein, 9 aa, Artificial Sequence
  Description of Artificial Sequence: Synthetic peptide
  Seed: TRVLAMAIY (TP53 R158L)
TSVLAMAIF

SEQ ID NO: 19128 - protein, 9 aa, Artificial Sequence
  Description of Artificial Sequence: Synthetic peptide
  Seed: TRVLAMAIY (TP53 R158L)
TSVLAMAIM

SEQ ID NO: 19129 - protein, 9 aa, Artificial Sequence
  Description of Artificial Sequence: Synthetic peptide
  Seed: TRVLAMAIY (TP53 R158L)
TSVLAMAIY

SEQ ID NO: 19130 - protein, 10 aa, Artificial Sequence
  Description of Artificial Sequence: Synthetic peptide
  Seed: TRVLAMAIYK (TP53 R158L)
TSVLAMAIYK

SEQ ID NO: 19131 - protein, 10 aa, Artificial Sequence
  Description of Artificial Sequence: Synthetic peptide
  Seed: TRVLAMAIYK (TP53 R158L)
TSVLAMAIYR

SEQ ID NO: 19132 - protein, 10 aa, Artificial Sequence
  Description of Artificial Sequence: Synthetic peptide
  Seed: TRVLAMAIYK (TP53 R158L)
TSVLAMAIYY

SEQ ID NO: 19133 - protein, 11 aa, Artificial Sequence
  Description of Artificial Sequence: Synthetic peptide
  Seed: TPPPGTRVLAM (TP53 R158L)
TTPPGTRVLAL

SEQ ID NO: 19134 - protein, 11 aa, Artificial Sequence
  Description of Artificial Sequence: Synthetic peptide
  Seed: TPPPGTRVLAM (TP53 R158L)
TTPPGTRVLAM

SEQ ID NO: 19135 - protein, 9 aa, Artificial Sequence
  Description of Artificial Sequence: Synthetic peptide
  Seed: TRVLAMAIY (TP53 R158L)
TTVLAMAIF

SEQ ID NO: 19136 - protein, 9 aa, Artificial Sequence
  Description of Artificial Sequence: Synthetic peptide
  Seed: TRVLAMAIY (TP53 R158L)
TTVLAMAIY

SEQ ID NO: 19137 - protein, 10 aa, Artificial Sequence
  Description of Artificial Sequence: Synthetic peptide
  Seed: TRVLAMAIYK (TP53 R158L)
TTVLAMAIYK

SEQ ID NO: 19138 - protein, 10 aa, Artificial Sequence
  Description of Artificial Sequence: Synthetic peptide
  Seed: TRVLAMAIYK (TP53 R158L)
TTVLAMAIYR

SEQ ID NO: 19139 - protein, 10 aa, Artificial Sequence
  Description of Artificial Sequence: Synthetic peptide
  Seed: TRVLAMAIYK (TP53 R158L)
TTVLAMAIYY

SEQ ID NO: 19140 - protein, 11 aa, Artificial Sequence
  Description of Artificial Sequence: Synthetic peptide
  Seed: TPPPGTRVLAM (TP53 R158L)
TVPPGTRVLAL

SEQ ID NO: 19141 - protein, 9 aa, Artificial Sequence
  Description of Artificial Sequence: Synthetic peptide
  Seed: TRVLAMAIY (TP53 R158L)
TVVLAMAIF

SEQ ID NO: 19142 - protein, 9 aa, Artificial Sequence
  Description of Artificial Sequence: Synthetic peptide
  Seed: TRVLAMAIY (TP53 R158L)
TVVLAMAIY

SEQ ID NO: 19143 - protein, 10 aa, Artificial Sequence
  Description of Artificial Sequence: Synthetic peptide
  Seed: TRVLAMAIYK (TP53 R158L)
TVVLAMAIYK

SEQ ID NO: 19144 - protein, 10 aa, Artificial Sequence
  Description of Artificial Sequence: Synthetic peptide
  Seed: TRVLAMAIYK (TP53 R158L)
TVVLAMAIYR

SEQ ID NO: 19145 - protein, 10 aa, Artificial Sequence
  Description of Artificial Sequence: Synthetic peptide
  Seed: TRVLAMAIYK (TP53 R158L)
TVVLAMAIYY

SEQ ID NO: 19146 - protein, 11 aa, Artificial Sequence
  Description of Artificial Sequence: Synthetic peptide
  Seed: TPPPGTRVLAM (TP53 R158L)
TWPPGTRVLAL

SEQ ID NO: 19147 - protein, 11 aa, Artificial Sequence
  Description of Artificial Sequence: Synthetic peptide
  Seed: TPPPGTRVLAM (TP53 R158L)
TWPPGTRVLAM

SEQ ID NO: 19148 - protein, 10 aa, Artificial Sequence
  Description of Artificial Sequence: Synthetic peptide
  Seed: TRVLAMAIYK (TP53 R158L)
TWVLAMAIYK

SEQ ID NO: 19149 - protein, 10 aa, Artificial Sequence
  Description of Artificial Sequence: Synthetic peptide
  Seed: TRVLAMAIYK (TP53 R158L)
TWVLAMAIYR

SEQ ID NO: 19150 - protein, 10 aa, Artificial Sequence
  Description of Artificial Sequence: Synthetic peptide
  Seed: TRVLAMAIYK (TP53 R158L)
TWVLAMAIYY

SEQ ID NO: 19151 - protein, 11 aa, Artificial Sequence
  Description of Artificial Sequence: Synthetic peptide
  Seed: TPPPGTRVLAM (TP53 R158L)
TYPPGTRVLAL

SEQ ID NO: 19152 - protein, 11 aa, Artificial Sequence
  Description of Artificial Sequence: Synthetic peptide
  Seed: TPPPGTRVLAM (TP53 R158L)
TYPPGTRVLAM

SEQ ID NO: 19153 - protein, 10 aa, Artificial Sequence
  Description of Artificial Sequence: Synthetic peptide
  Seed: TRVLAMAIYK (TP53 R158L)
TYVLAMAIYK

SEQ ID NO: 19154 - protein, 10 aa, Artificial Sequence
  Description of Artificial Sequence: Synthetic peptide
  Seed: TRVLAMAIYK (TP53 R158L)
TYVLAMAIYR

SEQ ID NO: 19155 - protein, 10 aa, Artificial Sequence
  Description of Artificial Sequence: Synthetic peptide
  Seed: TRVLAMAIYK (TP53 R158L)
TYVLAMAIYY

SEQ ID NO: 19156 - protein, 9 aa, Artificial Sequence
  Description of Artificial Sequence: Synthetic peptide
  Seed: GTRVLAMAI (TP53 R158L)
GARVLAMAH

SEQ ID NO: 19157 - protein, 9 aa, Artificial Sequence
  Description of Artificial Sequence: Synthetic peptide
  Seed: GTRVLAMAI (TP53 R158L)
GGRVLAMAM

SEQ ID NO: 19158 - protein, 9 aa, Artificial Sequence
  Description of Artificial Sequence: Synthetic peptide
  Seed: GTRVLAMAI (TP53 R158L)
GGRVLAMAY

SEQ ID NO: 19159 - protein, 9 aa, Artificial Sequence
  Description of Artificial Sequence: Synthetic peptide
  Seed: GTRVLAMAI (TP53 R158L)
GIRVLAMAF

SEQ ID NO: 19160 - protein, 9 aa, Artificial Sequence
  Description of Artificial Sequence: Synthetic peptide
  Seed: GTRVLAMAI (TP53 R158L)
GQRVLAMAY

SEQ ID NO: 19161 - protein, 9 aa, Artificial Sequence
  Description of Artificial Sequence: Synthetic peptide
  Seed: GTRVLAMAI (TP53 R158L)
GVRVLAMAF

SEQ ID NO: 19162 - protein, 9 aa, Artificial Sequence
  Description of Artificial Sequence: Synthetic peptide
  Seed: PPGTRVLAM (TP53 R158L)
PAGTRVLAA

SEQ ID NO: 19163 - protein, 9 aa, Artificial Sequence
  Description of Artificial Sequence: Synthetic peptide
  Seed: PPGTRVLAM (TP53 R158L)
PAGTRVLAF

SEQ ID NO: 19164 - protein, 9 aa, Artificial Sequence
  Description of Artificial Sequence: Synthetic peptide
  Seed: PPGTRVLAM (TP53 R158L)
PAGTRVLAI

SEQ ID NO: 19165 - protein, 9 aa, Artificial Sequence
  Description of Artificial Sequence: Synthetic peptide
  Seed: PPGTRVLAM (TP53 R158L)
PAGTRVLAL

SEQ ID NO: 19166 - protein, 9 aa, Artificial Sequence
  Description of Artificial Sequence: Synthetic peptide
  Seed: PPGTRVLAM (TP53 R158L)
PAGTRVLAM

SEQ ID NO: 19167 - protein, 9 aa, Artificial Sequence
  Description of Artificial Sequence: Synthetic peptide
  Seed: PPGTRVLAM (TP53 R158L)
PAGTRVLAV

SEQ ID NO: 19168 - protein, 9 aa, Artificial Sequence
  Description of Artificial Sequence: Synthetic peptide
  Seed: PPPGTRVLA (TP53 R158L)
PAPGTRVLA

SEQ ID NO: 19169 - protein, 10 aa, Artificial Sequence
  Description of Artificial Sequence: Synthetic peptide
  Seed: PPPGTRVLAM (TP53 R158L)
PAPGTRVLAA

SEQ ID NO: 19170 - protein, 10 aa, Artificial Sequence
  Description of Artificial Sequence: Synthetic peptide
  Seed: PPPGTRVLAM (TP53 R158L)
PAPGTRVLAL

SEQ ID NO: 19171 - protein, 10 aa, Artificial Sequence
  Description of Artificial Sequence: Synthetic peptide
  Seed: PPPGTRVLAM (TP53 R158L)
PAPGTRVLAM

SEQ ID NO: 19172 - protein, 9 aa, Artificial Sequence
  Description of Artificial Sequence: Synthetic peptide
  Seed: PPPGTRVLA (TP53 R158L)
PAPGTRVLL

SEQ ID NO: 19173 - protein, 9 aa, Artificial Sequence
  Description of Artificial Sequence: Synthetic peptide
  Seed: PPPGTRVLA (TP53 R158L)
PAPGTRVLM

SEQ ID NO: 19174 - protein, 9 aa, Artificial Sequence
  Description of Artificial Sequence: Synthetic peptide
  Seed: PPGTRVLAM (TP53 R158L)
PFGTRVLAL

SEQ ID NO: 19175 - protein, 9 aa, Artificial Sequence
  Description of Artificial Sequence: Synthetic peptide
  Seed: PPGTRVLAM (TP53 R158L)
PFGTRVLAM

SEQ ID NO: 19176 - protein, 9 aa, Artificial Sequence
  Description of Artificial Sequence: Synthetic peptide
  Seed: PPGTRVLAM (TP53 R158L)
PGGTRVLAL

SEQ ID NO: 19177 - protein, 9 aa, Artificial Sequence
  Description of Artificial Sequence: Synthetic peptide
  Seed: PPGTRVLAM (TP53 R158L)
PHGTRVLAL

SEQ ID NO: 19178 - protein, 9 aa, Artificial Sequence
  Description of Artificial Sequence: Synthetic peptide
  Seed: PPGTRVLAM (TP53 R158L)
PIGTRVLAI

SEQ ID NO: 19179 - protein, 9 aa, Artificial Sequence
  Description of Artificial Sequence: Synthetic peptide
  Seed: PPGTRVLAM (TP53 R158L)
PIGTRVLAL

SEQ ID NO: 19180 - protein, 9 aa, Artificial Sequence
  Description of Artificial Sequence: Synthetic peptide
  Seed: PPGTRVLAM (TP53 R158L)
PIGTRVLAM

SEQ ID NO: 19181 - protein, 9 aa, Artificial Sequence
  Description of Artificial Sequence: Synthetic peptide
  Seed: PPGTRVLAM (TP53 R158L)
PLGTRVLAI

SEQ ID NO: 19182 - protein, 9 aa, Artificial Sequence
  Description of Artificial Sequence: Synthetic peptide
  Seed: PPGTRVLAM (TP53 R158L)
PLGTRVLAL

SEQ ID NO: 19183 - protein, 9 aa, Artificial Sequence
  Description of Artificial Sequence: Synthetic peptide
  Seed: PPGTRVLAM (TP53 R158L)
PLGTRVLAM

SEQ ID NO: 19184 - protein, 9 aa, Artificial Sequence
  Description of Artificial Sequence: Synthetic peptide
  Seed: PPGTRVLAM (TP53 R158L)
PLGTRVLAV

SEQ ID NO: 19185 - protein, 9 aa, Artificial Sequence
  Description of Artificial Sequence: Synthetic peptide
  Seed: PPGTRVLAM (TP53 R158L)
PMGTRVLAF

SEQ ID NO: 19186 - protein, 9 aa, Artificial Sequence
  Description of Artificial Sequence: Synthetic peptide
  Seed: PPGTRVLAM (TP53 R158L)
PMGTRVLAI

SEQ ID NO: 19187 - protein, 9 aa, Artificial Sequence
  Description of Artificial Sequence: Synthetic peptide
  Seed: PPGTRVLAM (TP53 R158L)
PMGTRVLAL

SEQ ID NO: 19188 - protein, 9 aa, Artificial Sequence
  Description of Artificial Sequence: Synthetic peptide
  Seed: PPGTRVLAM (TP53 R158L)
PMGTRVLAM

SEQ ID NO: 19189 - protein, 9 aa, Artificial Sequence
  Description of Artificial Sequence: Synthetic peptide
  Seed: PPGTRVLAM (TP53 R158L)
PMGTRVLAV

SEQ ID NO: 19190 - protein, 9 aa, Artificial Sequence
  Description of Artificial Sequence: Synthetic peptide
  Seed: PPGTRVLAM (TP53 R158L)
PNGTRVLAL

SEQ ID NO: 19191 - protein, 9 aa, Artificial Sequence
  Description of Artificial Sequence: Synthetic peptide
  Seed: PPGTRVLAM (TP53 R158L)
PPGTRVLAA

SEQ ID NO: 19192 - protein, 9 aa, Artificial Sequence
  Description of Artificial Sequence: Synthetic peptide
  Seed: PPGTRVLAM (TP53 R158L)
PPGTRVLAC

SEQ ID NO: 19193 - protein, 9 aa, Artificial Sequence
  Description of Artificial Sequence: Synthetic peptide
  Seed: PPGTRVLAM (TP53 R158L)
PPGTRVLAF

SEQ ID NO: 19194 - protein, 9 aa, Artificial Sequence
  Description of Artificial Sequence: Synthetic peptide
  Seed: PPGTRVLAM (TP53 R158L)
PPGTRVLAI

SEQ ID NO: 19195 - protein, 9 aa, Artificial Sequence
  Description of Artificial Sequence: Synthetic peptide
  Seed: PPGTRVLAM (TP53 R158L)
PPGTRVLAP

SEQ ID NO: 19196 - protein, 9 aa, Artificial Sequence
  Description of Artificial Sequence: Synthetic peptide
  Seed: PPGTRVLAM (TP53 R158L)
PPGTRVLAV

SEQ ID NO: 19197 - protein, 10 aa, Artificial Sequence
  Description of Artificial Sequence: Synthetic peptide
  Seed: PPPGTRVLAM (TP53 R158L)
PPPGTRVLAA

SEQ ID NO: 19198 - protein, 10 aa, Artificial Sequence
  Description of Artificial Sequence: Synthetic peptide
  Seed: PPPGTRVLAM (TP53 R158L)
PPPGTRVLAF

SEQ ID NO: 19199 - protein, 10 aa, Artificial Sequence
  Description of Artificial Sequence: Synthetic peptide
  Seed: PPPGTRVLAM (TP53 R158L)
PPPGTRVLAI

SEQ ID NO: 19200 - protein, 10 aa, Artificial Sequence
  Description of Artificial Sequence: Synthetic peptide
  Seed: PPPGTRVLAM (TP53 R158L)
PPPGTRVLAL

SEQ ID NO: 19201 - protein, 10 aa, Artificial Sequence
  Description of Artificial Sequence: Synthetic peptide
  Seed: PPPGTRVLAM (TP53 R158L)
PPPGTRVLAP

SEQ ID NO: 19202 - protein, 10 aa, Artificial Sequence
  Description of Artificial Sequence: Synthetic peptide
  Seed: PPPGTRVLAM (TP53 R158L)
PPPGTRVLAV

SEQ ID NO: 19203 - protein, 9 aa, Artificial Sequence
  Description of Artificial Sequence: Synthetic peptide
  Seed: PPPGTRVLA (TP53 R158L)
PPPGTRVLF

SEQ ID NO: 19204 - protein, 9 aa, Artificial Sequence
  Description of Artificial Sequence: Synthetic peptide
  Seed: PPPGTRVLA (TP53 R158L)
PPPGTRVLI

SEQ ID NO: 19205 - protein, 9 aa, Artificial Sequence
  Description of Artificial Sequence: Synthetic peptide
  Seed: PPPGTRVLA (TP53 R158L)
PPPGTRVLL

SEQ ID NO: 19206 - protein, 9 aa, Artificial Sequence
  Description of Artificial Sequence: Synthetic peptide
  Seed: PPPGTRVLA (TP53 R158L)
PPPGTRVLM

SEQ ID NO: 19207 - protein, 9 aa, Artificial Sequence
  Description of Artificial Sequence: Synthetic peptide
  Seed: PPPGTRVLA (TP53 R158L)
PPPGTRVLP

SEQ ID NO: 19208 - protein, 9 aa, Artificial Sequence
  Description of Artificial Sequence: Synthetic peptide
  Seed: PPPGTRVLA (TP53 R158L)
PPPGTRVLV

SEQ ID NO: 19209 - protein, 9 aa, Artificial Sequence
  Description of Artificial Sequence: Synthetic peptide
  Seed: PPGTRVLAM (TP53 R158L)
PQGTRVLAI

SEQ ID NO: 19210 - protein, 9 aa, Artificial Sequence
  Description of Artificial Sequence: Synthetic peptide
  Seed: PPGTRVLAM (TP53 R158L)
PQGTRVLAL

SEQ ID NO: 19211 - protein, 9 aa, Artificial Sequence
  Description of Artificial Sequence: Synthetic peptide
  Seed: PPGTRVLAM (TP53 R158L)
PQGTRVLAM

SEQ ID NO: 19212 - protein, 9 aa, Artificial Sequence
  Description of Artificial Sequence: Synthetic peptide
  Seed: PPGTRVLAM (TP53 R158L)
PRGTRVLAL

SEQ ID NO: 19213 - protein, 9 aa, Artificial Sequence
  Description of Artificial Sequence: Synthetic peptide
  Seed: PPGTRVLAM (TP53 R158L)
PSGTRVLAL

SEQ ID NO: 19214 - protein, 9 aa, Artificial Sequence
  Description of Artificial Sequence: Synthetic peptide
  Seed: PPGTRVLAM (TP53 R158L)
PSGTRVLAM

SEQ ID NO: 19215 - protein, 9 aa, Artificial Sequence
  Description of Artificial Sequence: Synthetic peptide
  Seed: PPGTRVLAM (TP53 R158L)
PTGTRVLAL

SEQ ID NO: 19216 - protein, 9 aa, Artificial Sequence
  Description of Artificial Sequence: Synthetic peptide
  Seed: PPGTRVLAM (TP53 R158L)
PVGTRVLAA

SEQ ID NO: 19217 - protein, 9 aa, Artificial Sequence
  Description of Artificial Sequence: Synthetic peptide
  Seed: PPGTRVLAM (TP53 R158L)
PVGTRVLAL

SEQ ID NO: 19218 - protein, 9 aa, Artificial Sequence
  Description of Artificial Sequence: Synthetic peptide
  Seed: PPGTRVLAM (TP53 R158L)
PVGTRVLAM

SEQ ID NO: 19219 - protein, 9 aa, Artificial Sequence
  Description of Artificial Sequence: Synthetic peptide
  Seed: PPGTRVLAM (TP53 R158L)
PYGTRVLAL

SEQ ID NO: 19220 - protein, 9 aa, Artificial Sequence
  Description of Artificial Sequence: Synthetic peptide
  Seed: RVLAMAIYK (TP53 R158L)
RALAMAIYF

SEQ ID NO: 19221 - protein, 9 aa, Artificial Sequence
  Description of Artificial Sequence: Synthetic peptide
  Seed: RVLAMAIYK (TP53 R158L)
RALAMAIYW

SEQ ID NO: 19222 - protein, 9 aa, Artificial Sequence
  Description of Artificial Sequence: Synthetic peptide
  Seed: RVLAMAIYK (TP53 R158L)
RCLAMAIYF

SEQ ID NO: 19223 - protein, 9 aa, Artificial Sequence
  Description of Artificial Sequence: Synthetic peptide
  Seed: RVLAMAIYK (TP53 R158L)
RCLAMAIYY

SEQ ID NO: 19224 - protein, 9 aa, Artificial Sequence
  Description of Artificial Sequence: Synthetic peptide
  Seed: RVLAMAIYK (TP53 R158L)
RDLAMAIYK

SEQ ID NO: 19225 - protein, 9 aa, Artificial Sequence
  Description of Artificial Sequence: Synthetic peptide
  Seed: RVLAMAIYK (TP53 R158L)
RDLAMAIYY

SEQ ID NO: 19226 - protein, 9 aa, Artificial Sequence
  Description of Artificial Sequence: Synthetic peptide
  Seed: RVLAMAIYK (TP53 R158L)
RELAMAIYY

SEQ ID NO: 19227 - protein, 9 aa, Artificial Sequence
  Description of Artificial Sequence: Synthetic peptide
  Seed: RVLAMAIYK (TP53 R158L)
RFLAMAIYF

SEQ ID NO: 19228 - protein, 9 aa, Artificial Sequence
  Description of Artificial Sequence: Synthetic peptide
  Seed: RVLAMAIYK (TP53 R158L)
RFLAMAIYW

SEQ ID NO: 19229 - protein, 9 aa, Artificial Sequence
  Description of Artificial Sequence: Synthetic peptide
  Seed: RVLAMAIYK (TP53 R158L)
RGLAMAIYF

SEQ ID NO: 19230 - protein, 9 aa, Artificial Sequence
  Description of Artificial Sequence: Synthetic peptide
  Seed: RVLAMAIYK (TP53 R158L)
RGLAMAIYY

SEQ ID NO: 19231 - protein, 9 aa, Artificial Sequence
  Description of Artificial Sequence: Synthetic peptide
  Seed: RVLAMAIYK (TP53 R158L)
RHLAMAIYY

SEQ ID NO: 19232 - protein, 9 aa, Artificial Sequence
  Description of Artificial Sequence: Synthetic peptide
  Seed: RVLAMAIYK (TP53 R158L)
RILAMAIYF

SEQ ID NO: 19233 - protein, 9 aa, Artificial Sequence
  Description of Artificial Sequence: Synthetic peptide
  Seed: RVLAMAIYK (TP53 R158L)
RILAMAIYW

SEQ ID NO: 19234 - protein, 9 aa, Artificial Sequence
  Description of Artificial Sequence: Synthetic peptide
  Seed: RVLAMAIYK (TP53 R158L)
RKLAMAIYY

SEQ ID NO: 19235 - protein, 9 aa, Artificial Sequence
  Description of Artificial Sequence: Synthetic peptide
  Seed: RVLAMAIYK (TP53 R158L)
RLLAMAIYF

SEQ ID NO: 19236 - protein, 9 aa, Artificial Sequence
  Description of Artificial Sequence: Synthetic peptide
  Seed: RVLAMAIYK (TP53 R158L)
RLLAMAIYI

SEQ ID NO: 19237 - protein, 9 aa, Artificial Sequence
  Description of Artificial Sequence: Synthetic peptide
  Seed: RVLAMAIYK (TP53 R158L)
RLLAMAIYL

SEQ ID NO: 19238 - protein, 9 aa, Artificial Sequence
  Description of Artificial Sequence: Synthetic peptide
  Seed: RVLAMAIYK (TP53 R158L)
RLLAMAIYM

SEQ ID NO: 19239 - protein, 9 aa, Artificial Sequence
  Description of Artificial Sequence: Synthetic peptide
  Seed: RVLAMAIYK (TP53 R158L)
RLLAMAIYV

SEQ ID NO: 19240 - protein, 9 aa, Artificial Sequence
  Description of Artificial Sequence: Synthetic peptide
  Seed: RVLAMAIYK (TP53 R158L)
RLLAMAIYW

SEQ ID NO: 19241 - protein, 9 aa, Artificial Sequence
  Description of Artificial Sequence: Synthetic peptide
  Seed: RVLAMAIYK (TP53 R158L)
RMLAMAIYW

SEQ ID NO: 19242 - protein, 9 aa, Artificial Sequence
  Description of Artificial Sequence: Synthetic peptide
  Seed: RVLAMAIYK (TP53 R158L)
RNLAMAIYF

SEQ ID NO: 19243 - protein, 9 aa, Artificial Sequence
  Description of Artificial Sequence: Synthetic peptide
  Seed: RVLAMAIYK (TP53 R158L)
RNLAMAIYY

SEQ ID NO: 19244 - protein, 9 aa, Artificial Sequence
  Description of Artificial Sequence: Synthetic peptide
  Seed: RVLAMAIYK (TP53 R158L)
RPLAMAIYK

SEQ ID NO: 19245 - protein, 9 aa, Artificial Sequence
  Description of Artificial Sequence: Synthetic peptide
  Seed: RVLAMAIYK (TP53 R158L)
RPLAMAIYY

SEQ ID NO: 19246 - protein, 9 aa, Artificial Sequence
  Description of Artificial Sequence: Synthetic peptide
  Seed: RVLAMAIYK (TP53 R158L)
RQLAMAIYF

SEQ ID NO: 19247 - protein, 9 aa, Artificial Sequence
  Description of Artificial Sequence: Synthetic peptide
  Seed: RVLAMAIYK (TP53 R158L)
RQLAMAIYL

SEQ ID NO: 19248 - protein, 9 aa, Artificial Sequence
  Description of Artificial Sequence: Synthetic peptide
  Seed: RVLAMAIYK (TP53 R158L)
RQLAMAIYW

SEQ ID NO: 19249 - protein, 9 aa, Artificial Sequence
  Description of Artificial Sequence: Synthetic peptide
  Seed: RVLAMAIYK (TP53 R158L)
RRLAMAIYY

SEQ ID NO: 19250 - protein, 9 aa, Artificial Sequence
  Description of Artificial Sequence: Synthetic peptide
  Seed: RVLAMAIYK (TP53 R158L)
RSLAMAIYF

SEQ ID NO: 19251 - protein, 9 aa, Artificial Sequence
  Description of Artificial Sequence: Synthetic peptide
  Seed: RVLAMAIYK (TP53 R158L)
RSLAMAIYW

SEQ ID NO: 19252 - protein, 9 aa, Artificial Sequence
  Description of Artificial Sequence: Synthetic peptide
  Seed: RVLAMAIYK (TP53 R158L)
RTLAMAIYW

SEQ ID NO: 19253 - protein, 9 aa, Artificial Sequence
  Description of Artificial Sequence: Synthetic peptide
  Seed: RVLAMAIYK (TP53 R158L)
RVLAMAIYF

SEQ ID NO: 19254 - protein, 9 aa, Artificial Sequence
  Description of Artificial Sequence: Synthetic peptide
  Seed: RVLAMAIYK (TP53 R158L)
RVLAMAIYW

SEQ ID NO: 19255 - protein, 9 aa, Artificial Sequence
  Description of Artificial Sequence: Synthetic peptide
  Seed: RVLAMAIYK (TP53 R158L)
RWLAMAIYF

SEQ ID NO: 19256 - protein, 9 aa, Artificial Sequence
  Description of Artificial Sequence: Synthetic peptide
  Seed: RVLAMAIYK (TP53 R158L)
RWLAMAIYW

SEQ ID NO: 19257 - protein, 9 aa, Artificial Sequence
  Description of Artificial Sequence: Synthetic peptide
  Seed: RVLAMAIYK (TP53 R158L)
RYLAMAIYF

SEQ ID NO: 19258 - protein, 9 aa, Artificial Sequence
  Description of Artificial Sequence: Synthetic peptide
  Seed: RVLAMAIYK (TP53 R158L)
RYLAMAIYW

SEQ ID NO: 19259 - protein, 10 aa, Artificial Sequence
  Description of Artificial Sequence: Synthetic peptide
  Seed: TPPPGTRVLA (TP53 R158L)
TAPPGTRVLA

SEQ ID NO: 19260 - protein, 11 aa, Artificial Sequence
  Description of Artificial Sequence: Synthetic peptide
  Seed: TPPPGTRVLAM (TP53 R158L)
TAPPGTRVLAA

SEQ ID NO: 19261 - protein, 11 aa, Artificial Sequence
  Description of Artificial Sequence: Synthetic peptide
  Seed: TPPPGTRVLAM (TP53 R158L)
TAPPGTRVLAC

SEQ ID NO: 19262 - protein, 11 aa, Artificial Sequence
  Description of Artificial Sequence: Synthetic peptide
  Seed: TPPPGTRVLAM (TP53 R158L)
TAPPGTRVLAF

SEQ ID NO: 19263 - protein, 11 aa, Artificial Sequence
  Description of Artificial Sequence: Synthetic peptide
  Seed: TPPPGTRVLAM (TP53 R158L)
TAPPGTRVLAI

SEQ ID NO: 19264 - protein, 11 aa, Artificial Sequence
  Description of Artificial Sequence: Synthetic peptide
  Seed: TPPPGTRVLAM (TP53 R158L)
TAPPGTRVLAK

SEQ ID NO: 19265 - protein, 11 aa, Artificial Sequence
  Description of Artificial Sequence: Synthetic peptide
  Seed: TPPPGTRVLAM (TP53 R158L)
TAPPGTRVLAV

SEQ ID NO: 19266 - protein, 11 aa, Artificial Sequence
  Description of Artificial Sequence: Synthetic peptide
  Seed: TPPPGTRVLAM (TP53 R158L)
TAPPGTRVLAW

SEQ ID NO: 19267 - protein, 11 aa, Artificial Sequence
  Description of Artificial Sequence: Synthetic peptide
  Seed: TPPPGTRVLAM (TP53 R158L)
TAPPGTRVLAY

SEQ ID NO: 19268 - protein, 10 aa, Artificial Sequence
  Description of Artificial Sequence: Synthetic peptide
  Seed: TPPPGTRVLA (TP53 R158L)
TAPPGTRVLC

SEQ ID NO: 19269 - protein, 10 aa, Artificial Sequence
  Description of Artificial Sequence: Synthetic peptide
  Seed: TPPPGTRVLA (TP53 R158L)
TAPPGTRVLI

SEQ ID NO: 19270 - protein, 10 aa, Artificial Sequence
  Description of Artificial Sequence: Synthetic peptide
  Seed: TPPPGTRVLA (TP53 R158L)
TAPPGTRVLL

SEQ ID NO: 19271 - protein, 10 aa, Artificial Sequence
  Description of Artificial Sequence: Synthetic peptide
  Seed: TPPPGTRVLA (TP53 R158L)
TAPPGTRVLM

SEQ ID NO: 19272 - protein, 10 aa, Artificial Sequence
  Description of Artificial Sequence: Synthetic peptide
  Seed: TPPPGTRVLA (TP53 R158L)
TAPPGTRVLV

SEQ ID NO: 19273 - protein, 11 aa, Artificial Sequence
  Description of Artificial Sequence: Synthetic peptide
  Seed: TPPPGTRVLAM (TP53 R158L)
TCPPGTRVLAF

SEQ ID NO: 19274 - protein, 11 aa, Artificial Sequence
  Description of Artificial Sequence: Synthetic peptide
  Seed: TPPPGTRVLAM (TP53 R158L)
TCPPGTRVLAI

SEQ ID NO: 19275 - protein, 11 aa, Artificial Sequence
  Description of Artificial Sequence: Synthetic peptide
  Seed: TPPPGTRVLAM (TP53 R158L)
TCPPGTRVLAV

SEQ ID NO: 19276 - protein, 9 aa, Artificial Sequence
  Description of Artificial Sequence: Synthetic peptide
  Seed: TRVLAMAIY (TP53 R158L)
TCVLAMAIY

SEQ ID NO: 19277 - protein, 11 aa, Artificial Sequence
  Description of Artificial Sequence: Synthetic peptide
  Seed: TPPPGTRVLAM (TP53 R158L)
TEPPGTRVLAF

SEQ ID NO: 19278 - protein, 11 aa, Artificial Sequence
  Description of Artificial Sequence: Synthetic peptide
  Seed: TPPPGTRVLAM (TP53 R158L)
TFPPGTRVLAF

SEQ ID NO: 19279 - protein, 11 aa, Artificial Sequence
  Description of Artificial Sequence: Synthetic peptide
  Seed: TPPPGTRVLAM (TP53 R158L)
TFPPGTRVLAI

SEQ ID NO: 19280 - protein, 9 aa, Artificial Sequence
  Description of Artificial Sequence: Synthetic peptide
  Seed: TRVLAMAIY (TP53 R158L)
TFVLAMAIF

SEQ ID NO: 19281 - protein, 9 aa, Artificial Sequence
  Description of Artificial Sequence: Synthetic peptide
  Seed: TRVLAMAIY (TP53 R158L)
TFVLAMAIY

SEQ ID NO: 19282 - protein, 11 aa, Artificial Sequence
  Description of Artificial Sequence: Synthetic peptide
  Seed: TPPPGTRVLAM (TP53 R158L)
TGPPGTRVLAF

SEQ ID NO: 19283 - protein, 11 aa, Artificial Sequence
  Description of Artificial Sequence: Synthetic peptide
  Seed: TPPPGTRVLAM (TP53 R158L)
TGPPGTRVLAI

SEQ ID NO: 19284 - protein, 11 aa, Artificial Sequence
  Description of Artificial Sequence: Synthetic peptide
  Seed: TPPPGTRVLAM (TP53 R158L)
TGPPGTRVLAV

SEQ ID NO: 19285 - protein, 11 aa, Artificial Sequence
  Description of Artificial Sequence: Synthetic peptide
  Seed: TPPPGTRVLAM (TP53 R158L)
THPPGTRVLAF

SEQ ID NO: 19286 - protein, 8 aa, Artificial Sequence
  Description of Artificial Sequence: Synthetic peptide
  Seed: TRVLAMAI (TP53 R158L)
THVLAMAC

SEQ ID NO: 19287 - protein, 8 aa, Artificial Sequence
  Description of Artificial Sequence: Synthetic peptide
  Seed: TRVLAMAI (TP53 R158L)
THVLAMAF

SEQ ID NO: 19288 - protein, 8 aa, Artificial Sequence
  Description of Artificial Sequence: Synthetic peptide
  Seed: TRVLAMAI (TP53 R158L)
THVLAMAG

SEQ ID NO: 19289 - protein, 8 aa, Artificial Sequence
  Description of Artificial Sequence: Synthetic peptide
  Seed: TRVLAMAI (TP53 R158L)
THVLAMAI

SEQ ID NO: 19290 - protein, 9 aa, Artificial Sequence
  Description of Artificial Sequence: Synthetic peptide
  Seed: TRVLAMAIY (TP53 R158L)
THVLAMAIL

SEQ ID NO: 19291 - protein, 8 aa, Artificial Sequence
  Description of Artificial Sequence: Synthetic peptide
  Seed: TRVLAMAI (TP53 R158L)
THVLAMAL

SEQ ID NO: 19292 - protein, 8 aa, Artificial Sequence
  Description of Artificial Sequence: Synthetic peptide
  Seed: TRVLAMAI (TP53 R158L)
THVLAMAM

SEQ ID NO: 19293 - protein, 8 aa, Artificial Sequence
  Description of Artificial Sequence: Synthetic peptide
  Seed: TRVLAMAI (TP53 R158L)
THVLAMAP

SEQ ID NO: 19294 - protein, 8 aa, Artificial Sequence
  Description of Artificial Sequence: Synthetic peptide
  Seed: TRVLAMAI (TP53 R158L)
THVLAMAS

SEQ ID NO: 19295 - protein, 8 aa, Artificial Sequence
  Description of Artificial Sequence: Synthetic peptide
  Seed: TRVLAMAI (TP53 R158L)
THVLAMAT

SEQ ID NO: 19296 - protein, 8 aa, Artificial Sequence
  Description of Artificial Sequence: Synthetic peptide
  Seed: TRVLAMAI (TP53 R158L)
THVLAMAV

SEQ ID NO: 19297 - protein, 11 aa, Artificial Sequence
  Description of Artificial Sequence: Synthetic peptide
  Seed: TPPPGTRVLAM (TP53 R158L)
TIPPGTRVLAC

SEQ ID NO: 19298 - protein, 11 aa, Artificial Sequence
  Description of Artificial Sequence: Synthetic peptide
  Seed: TPPPGTRVLAM (TP53 R158L)
TIPPGTRVLAF

SEQ ID NO: 19299 - protein, 11 aa, Artificial Sequence
  Description of Artificial Sequence: Synthetic peptide
  Seed: TPPPGTRVLAM (TP53 R158L)
TIPPGTRVLAI

SEQ ID NO: 19300 - protein, 11 aa, Artificial Sequence
  Description of Artificial Sequence: Synthetic peptide
  Seed: TPPPGTRVLAM (TP53 R158L)
TIPPGTRVLAV

SEQ ID NO: 19301 - protein, 11 aa, Artificial Sequence
  Description of Artificial Sequence: Synthetic peptide
  Seed: TPPPGTRVLAM (TP53 R158L)
TLPPGTRVLAC

SEQ ID NO: 19302 - protein, 11 aa, Artificial Sequence
  Description of Artificial Sequence: Synthetic peptide
  Seed: TPPPGTRVLAM (TP53 R158L)
TLPPGTRVLAF

SEQ ID NO: 19303 - protein, 11 aa, Artificial Sequence
  Description of Artificial Sequence: Synthetic peptide
  Seed: TPPPGTRVLAM (TP53 R158L)
TLPPGTRVLAI

SEQ ID NO: 19304 - protein, 11 aa, Artificial Sequence
  Description of Artificial Sequence: Synthetic peptide
  Seed: TPPPGTRVLAM (TP53 R158L)
TLPPGTRVLAV

SEQ ID NO: 19305 - protein, 11 aa, Artificial Sequence
  Description of Artificial Sequence: Synthetic peptide
  Seed: TPPPGTRVLAM (TP53 R158L)
TMPPGTRVLAC

SEQ ID NO: 19306 - protein, 11 aa, Artificial Sequence
  Description of Artificial Sequence: Synthetic peptide
  Seed: TPPPGTRVLAM (TP53 R158L)
TMPPGTRVLAF

SEQ ID NO: 19307 - protein, 11 aa, Artificial Sequence
  Description of Artificial Sequence: Synthetic peptide
  Seed: TPPPGTRVLAM (TP53 R158L)
TMPPGTRVLAI

SEQ ID NO: 19308 - protein, 11 aa, Artificial Sequence
  Description of Artificial Sequence: Synthetic peptide
  Seed: TPPPGTRVLAM (TP53 R158L)
TMPPGTRVLAV

SEQ ID NO: 19309 - protein, 10 aa, Artificial Sequence
  Description of Artificial Sequence: Synthetic peptide
  Seed: TPPPGTRVLA (TP53 R158L)
TMPPGTRVLL

SEQ ID NO: 19310 - protein, 11 aa, Artificial Sequence
  Description of Artificial Sequence: Synthetic peptide
  Seed: TPPPGTRVLAM (TP53 R158L)
TNPPGTRVLAF

SEQ ID NO: 19311 - protein, 11 aa, Artificial Sequence
  Description of Artificial Sequence: Synthetic peptide
  Seed: TPPPGTRVLAM (TP53 R158L)
TPPPGTRVLAA

SEQ ID NO: 19312 - protein, 11 aa, Artificial Sequence
  Description of Artificial Sequence: Synthetic peptide
  Seed: TPPPGTRVLAM (TP53 R158L)
TPPPGTRVLAC

SEQ ID NO: 19313 - protein, 11 aa, Artificial Sequence
  Description of Artificial Sequence: Synthetic peptide
  Seed: TPPPGTRVLAM (TP53 R158L)
TPPPGTRVLAF

SEQ ID NO: 19314 - protein, 11 aa, Artificial Sequence
  Description of Artificial Sequence: Synthetic peptide
  Seed: TPPPGTRVLAM (TP53 R158L)
TPPPGTRVLAG

SEQ ID NO: 19315 - protein, 11 aa, Artificial Sequence
  Description of Artificial Sequence: Synthetic peptide
  Seed: TPPPGTRVLAM (TP53 R158L)
TPPPGTRVLAK

SEQ ID NO: 19316 - protein, 11 aa, Artificial Sequence
  Description of Artificial Sequence: Synthetic peptide
  Seed: TPPPGTRVLAM (TP53 R158L)
TPPPGTRVLAP

SEQ ID NO: 19317 - protein, 11 aa, Artificial Sequence
  Description of Artificial Sequence: Synthetic peptide
  Seed: TPPPGTRVLAM (TP53 R158L)
TPPPGTRVLAR

SEQ ID NO: 19318 - protein, 11 aa, Artificial Sequence
  Description of Artificial Sequence: Synthetic peptide
  Seed: TPPPGTRVLAM (TP53 R158L)
TPPPGTRVLAS

SEQ ID NO: 19319 - protein, 11 aa, Artificial Sequence
  Description of Artificial Sequence: Synthetic peptide
  Seed: TPPPGTRVLAM (TP53 R158L)
TPPPGTRVLAT

SEQ ID NO: 19320 - protein, 11 aa, Artificial Sequence
  Description of Artificial Sequence: Synthetic peptide
  Seed: TPPPGTRVLAM (TP53 R158L)
TPPPGTRVLAV

SEQ ID NO: 19321 - protein, 11 aa, Artificial Sequence
  Description of Artificial Sequence: Synthetic peptide
  Seed: TPPPGTRVLAM (TP53 R158L)
TPPPGTRVLAW

SEQ ID NO: 19322 - protein, 11 aa, Artificial Sequence
  Description of Artificial Sequence: Synthetic peptide
  Seed: TPPPGTRVLAM (TP53 R158L)
TPPPGTRVLAY

SEQ ID NO: 19323 - protein, 10 aa, Artificial Sequence
  Description of Artificial Sequence: Synthetic peptide
  Seed: TPPPGTRVLA (TP53 R158L)
TPPPGTRVLC

SEQ ID NO: 19324 - protein, 10 aa, Artificial Sequence
  Description of Artificial Sequence: Synthetic peptide
  Seed: TPPPGTRVLA (TP53 R158L)
TPPPGTRVLF

SEQ ID NO: 19325 - protein, 10 aa, Artificial Sequence
  Description of Artificial Sequence: Synthetic peptide
  Seed: TPPPGTRVLA (TP53 R158L)
TPPPGTRVLG

SEQ ID NO: 19326 - protein, 10 aa, Artificial Sequence
  Description of Artificial Sequence: Synthetic peptide
  Seed: TPPPGTRVLA (TP53 R158L)
TPPPGTRVLI

SEQ ID NO: 19327 - protein, 10 aa, Artificial Sequence
  Description of Artificial Sequence: Synthetic peptide
  Seed: TPPPGTRVLA (TP53 R158L)
TPPPGTRVLK

SEQ ID NO: 19328 - protein, 10 aa, Artificial Sequence
  Description of Artificial Sequence: Synthetic peptide
  Seed: TPPPGTRVLA (TP53 R158L)
TPPPGTRVLM

SEQ ID NO: 19329 - protein, 10 aa, Artificial Sequence
  Description of Artificial Sequence: Synthetic peptide
  Seed: TPPPGTRVLA (TP53 R158L)
TPPPGTRVLP

SEQ ID NO: 19330 - protein, 10 aa, Artificial Sequence
  Description of Artificial Sequence: Synthetic peptide
  Seed: TPPPGTRVLA (TP53 R158L)
TPPPGTRVLR

SEQ ID NO: 19331 - protein, 10 aa, Artificial Sequence
  Description of Artificial Sequence: Synthetic peptide
  Seed: TPPPGTRVLA (TP53 R158L)
TPPPGTRVLS

SEQ ID NO: 19332 - protein, 10 aa, Artificial Sequence
  Description of Artificial Sequence: Synthetic peptide
  Seed: TPPPGTRVLA (TP53 R158L)
TPPPGTRVLT

SEQ ID NO: 19333 - protein, 10 aa, Artificial Sequence
  Description of Artificial Sequence: Synthetic peptide
  Seed: TPPPGTRVLA (TP53 R158L)
TPPPGTRVLV

SEQ ID NO: 19334 - protein, 10 aa, Artificial Sequence
  Description of Artificial Sequence: Synthetic peptide
  Seed: TPPPGTRVLA (TP53 R158L)
TPPPGTRVLW

SEQ ID NO: 19335 - protein, 10 aa, Artificial Sequence
  Description of Artificial Sequence: Synthetic peptide
  Seed: TPPPGTRVLA (TP53 R158L)
TPPPGTRVLY

SEQ ID NO: 19336 - protein, 9 aa, Artificial Sequence
  Description of Artificial Sequence: Synthetic peptide
  Seed: TRVLAMAIY (TP53 R158L)
TPVLAMAIF

SEQ ID NO: 19337 - protein, 9 aa, Artificial Sequence
  Description of Artificial Sequence: Synthetic peptide
  Seed: TRVLAMAIY (TP53 R158L)
TPVLAMAIY

SEQ ID NO: 19338 - protein, 11 aa, Artificial Sequence
  Description of Artificial Sequence: Synthetic peptide
  Seed: TPPPGTRVLAM (TP53 R158L)
TQPPGTRVLAF

SEQ ID NO: 19339 - protein, 11 aa, Artificial Sequence
  Description of Artificial Sequence: Synthetic peptide
  Seed: TPPPGTRVLAM (TP53 R158L)
TQPPGTRVLAI

SEQ ID NO: 19340 - protein, 11 aa, Artificial Sequence
  Description of Artificial Sequence: Synthetic peptide
  Seed: TPPPGTRVLAM (TP53 R158L)
TQPPGTRVLAV

SEQ ID NO: 19341 - protein, 8 aa, Artificial Sequence
  Description of Artificial Sequence: Synthetic peptide
  Seed: TRVLAMAI (TP53 R158L)
TQVLAMAA

SEQ ID NO: 19342 - protein, 8 aa, Artificial Sequence
  Description of Artificial Sequence: Synthetic peptide
  Seed: TRVLAMAI (TP53 R158L)
TQVLAMAI

SEQ ID NO: 19343 - protein, 8 aa, Artificial Sequence
  Description of Artificial Sequence: Synthetic peptide
  Seed: TRVLAMAI (TP53 R158L)
TQVLAMAL

SEQ ID NO: 19344 - protein, 8 aa, Artificial Sequence
  Description of Artificial Sequence: Synthetic peptide
  Seed: TRVLAMAI (TP53 R158L)
TQVLAMAV

SEQ ID NO: 19345 - protein, 11 aa, Artificial Sequence
  Description of Artificial Sequence: Synthetic peptide
  Seed: TPPPGTRVLAM (TP53 R158L)
TRPPGTRVLAC

SEQ ID NO: 19346 - protein, 11 aa, Artificial Sequence
  Description of Artificial Sequence: Synthetic peptide
  Seed: TPPPGTRVLAM (TP53 R158L)
TRPPGTRVLAF

SEQ ID NO: 19347 - protein, 11 aa, Artificial Sequence
  Description of Artificial Sequence: Synthetic peptide
  Seed: TPPPGTRVLAM (TP53 R158L)
TRPPGTRVLAI

SEQ ID NO: 19348 - protein, 11 aa, Artificial Sequence
  Description of Artificial Sequence: Synthetic peptide
  Seed: TPPPGTRVLAM (TP53 R158L)
TRPPGTRVLAV

SEQ ID NO: 19349 - protein, 8 aa, Artificial Sequence
  Description of Artificial Sequence: Synthetic peptide
  Seed: TRVLAMAI (TP53 R158L)
TRVLAMAA

SEQ ID NO: 19350 - protein, 8 aa, Artificial Sequence
  Description of Artificial Sequence: Synthetic peptide
  Seed: TRVLAMAI (TP53 R158L)
TRVLAMAC

SEQ ID NO: 19351 - protein, 8 aa, Artificial Sequence
  Description of Artificial Sequence: Synthetic peptide
  Seed: TRVLAMAI (TP53 R158L)
TRVLAMAF

SEQ ID NO: 19352 - protein, 9 aa, Artificial Sequence
  Description of Artificial Sequence: Synthetic peptide
  Seed: TRVLAMAIY (TP53 R158L)
TRVLAMAIH

SEQ ID NO: 19353 - protein, 9 aa, Artificial Sequence
  Description of Artificial Sequence: Synthetic peptide
  Seed: TRVLAMAIY (TP53 R158L)
TRVLAMAII

SEQ ID NO: 19354 - protein, 9 aa, Artificial Sequence
  Description of Artificial Sequence: Synthetic peptide
  Seed: TRVLAMAIY (TP53 R158L)
TRVLAMAIK

SEQ ID NO: 19355 - protein, 9 aa, Artificial Sequence
  Description of Artificial Sequence: Synthetic peptide
  Seed: TRVLAMAIY (TP53 R158L)
TRVLAMAIL

SEQ ID NO: 19356 - protein, 9 aa, Artificial Sequence
  Description of Artificial Sequence: Synthetic peptide
  Seed: TRVLAMAIY (TP53 R158L)
TRVLAMAIR

SEQ ID NO: 19357 - protein, 9 aa, Artificial Sequence
  Description of Artificial Sequence: Synthetic peptide
  Seed: TRVLAMAIY (TP53 R158L)
TRVLAMAIV

SEQ ID NO: 19358 - protein, 9 aa, Artificial Sequence
  Description of Artificial Sequence: Synthetic peptide
  Seed: TRVLAMAIY (TP53 R158L)
TRVLAMAIW

SEQ ID NO: 19359 - protein, 8 aa, Artificial Sequence
  Description of Artificial Sequence: Synthetic peptide
  Seed: TRVLAMAI (TP53 R158L)
TRVLAMAL

SEQ ID NO: 19360 - protein, 8 aa, Artificial Sequence
  Description of Artificial Sequence: Synthetic peptide
  Seed: TRVLAMAI (TP53 R158L)
TRVLAMAM

SEQ ID NO: 19361 - protein, 8 aa, Artificial Sequence
  Description of Artificial Sequence: Synthetic peptide
  Seed: TRVLAMAI (TP53 R158L)
TRVLAMAV

SEQ ID NO: 19362 - protein, 11 aa, Artificial Sequence
  Description of Artificial Sequence: Synthetic peptide
  Seed: TPPPGTRVLAM (TP53 R158L)
TSPPGTRVLAC

SEQ ID NO: 19363 - protein, 11 aa, Artificial Sequence
  Description of Artificial Sequence: Synthetic peptide
  Seed: TPPPGTRVLAM (TP53 R158L)
TSPPGTRVLAF

SEQ ID NO: 19364 - protein, 11 aa, Artificial Sequence
  Description of Artificial Sequence: Synthetic peptide
  Seed: TPPPGTRVLAM (TP53 R158L)
TSPPGTRVLAI

SEQ ID NO: 19365 - protein, 11 aa, Artificial Sequence
  Description of Artificial Sequence: Synthetic peptide
  Seed: TPPPGTRVLAM (TP53 R158L)
TSPPGTRVLAV

SEQ ID NO: 19366 - protein, 11 aa, Artificial Sequence
  Description of Artificial Sequence: Synthetic peptide
  Seed: TPPPGTRVLAM (TP53 R158L)
TSPPGTRVLAY

SEQ ID NO: 19367 - protein, 10 aa, Artificial Sequence
  Description of Artificial Sequence: Synthetic peptide
  Seed: TPPPGTRVLA (TP53 R158L)
TSPPGTRVLI

SEQ ID NO: 19368 - protein, 10 aa, Artificial Sequence
  Description of Artificial Sequence: Synthetic peptide
  Seed: TPPPGTRVLA (TP53 R158L)
TSPPGTRVLL

SEQ ID NO: 19369 - protein, 10 aa, Artificial Sequence
  Description of Artificial Sequence: Synthetic peptide
  Seed: TPPPGTRVLA (TP53 R158L)
TSPPGTRVLV

SEQ ID NO: 19370 - protein, 11 aa, Artificial Sequence
  Description of Artificial Sequence: Synthetic peptide
  Seed: TPPPGTRVLAM (TP53 R158L)
TTPPGTRVLAF

SEQ ID NO: 19371 - protein, 11 aa, Artificial Sequence
  Description of Artificial Sequence: Synthetic peptide
  Seed: TPPPGTRVLAM (TP53 R158L)
TTPPGTRVLAI

SEQ ID NO: 19372 - protein, 11 aa, Artificial Sequence
  Description of Artificial Sequence: Synthetic peptide
  Seed: TPPPGTRVLAM (TP53 R158L)
TTPPGTRVLAV

SEQ ID NO: 19373 - protein, 10 aa, Artificial Sequence
  Description of Artificial Sequence: Synthetic peptide
  Seed: TPPPGTRVLA (TP53 R158L)
TVPPGTRVLA

SEQ ID NO: 19374 - protein, 11 aa, Artificial Sequence
  Description of Artificial Sequence: Synthetic peptide
  Seed: TPPPGTRVLAM (TP53 R158L)
TVPPGTRVLAA

SEQ ID NO: 19375 - protein, 11 aa, Artificial Sequence
  Description of Artificial Sequence: Synthetic peptide
  Seed: TPPPGTRVLAM (TP53 R158L)
TVPPGTRVLAC

SEQ ID NO: 19376 - protein, 11 aa, Artificial Sequence
  Description of Artificial Sequence: Synthetic peptide
  Seed: TPPPGTRVLAM (TP53 R158L)
TVPPGTRVLAF

SEQ ID NO: 19377 - protein, 11 aa, Artificial Sequence
  Description of Artificial Sequence: Synthetic peptide
  Seed: TPPPGTRVLAM (TP53 R158L)
TVPPGTRVLAI

SEQ ID NO: 19378 - protein, 11 aa, Artificial Sequence
  Description of Artificial Sequence: Synthetic peptide
  Seed: TPPPGTRVLAM (TP53 R158L)
TVPPGTRVLAV

SEQ ID NO: 19379 - protein, 11 aa, Artificial Sequence
  Description of Artificial Sequence: Synthetic peptide
  Seed: TPPPGTRVLAM (TP53 R158L)
TVPPGTRVLAY

SEQ ID NO: 19380 - protein, 10 aa, Artificial Sequence
  Description of Artificial Sequence: Synthetic peptide
  Seed: TPPPGTRVLA (TP53 R158L)
TVPPGTRVLI

SEQ ID NO: 19381 - protein, 10 aa, Artificial Sequence
  Description of Artificial Sequence: Synthetic peptide
  Seed: TPPPGTRVLA (TP53 R158L)
TVPPGTRVLL

SEQ ID NO: 19382 - protein, 10 aa, Artificial Sequence
  Description of Artificial Sequence: Synthetic peptide
  Seed: TPPPGTRVLA (TP53 R158L)
TVPPGTRVLV

SEQ ID NO: 19383 - protein, 9 aa, Artificial Sequence
  Description of Artificial Sequence: Synthetic peptide
  Seed: TRVLAMAIY (TP53 R158L)
TVVLAMAIM

SEQ ID NO: 19384 - protein, 11 aa, Artificial Sequence
  Description of Artificial Sequence: Synthetic peptide
  Seed: TPPPGTRVLAM (TP53 R158L)
TWPPGTRVLAF

SEQ ID NO: 19385 - protein, 11 aa, Artificial Sequence
  Description of Artificial Sequence: Synthetic peptide
  Seed: TPPPGTRVLAM (TP53 R158L)
TYPPGTRVLAC

SEQ ID NO: 19386 - protein, 11 aa, Artificial Sequence
  Description of Artificial Sequence: Synthetic peptide
  Seed: TPPPGTRVLAM (TP53 R158L)
TYPPGTRVLAF

SEQ ID NO: 19387 - protein, 11 aa, Artificial Sequence
  Description of Artificial Sequence: Synthetic peptide
  Seed: TPPPGTRVLAM (TP53 R158L)
TYPPGTRVLAI

SEQ ID NO: 19388 - protein, 11 aa, Artificial Sequence
  Description of Artificial Sequence: Synthetic peptide
  Seed: TPPPGTRVLAM (TP53 R158L)
TYPPGTRVLAV

SEQ ID NO: 19389 - protein, 9 aa, Artificial Sequence
  Description of Artificial Sequence: Synthetic peptide
  Seed: TRVLAMAIY (TP53 R158L)
TYVLAMAIF

SEQ ID NO: 19390 - protein, 9 aa, Artificial Sequence
  Description of Artificial Sequence: Synthetic peptide
  Seed: TRVLAMAIY (TP53 R158L)
TYVLAMAIL

SEQ ID NO: 19391 - protein, 9 aa, Artificial Sequence
  Description of Artificial Sequence: Synthetic peptide
  Seed: TRVLAMAIY (TP53 R158L)
TYVLAMAIM

SEQ ID NO: 19392 - protein, 9 aa, Artificial Sequence
  Description of Artificial Sequence: Synthetic peptide
  Seed: TRVLAMAIY (TP53 R158L)
TYVLAMAIY

SEQ ID NO: 19393 - protein, 9 aa, Homo sapiens
  Native (TP53 R158L)
GTRVLAMAI

SEQ ID NO: 19394 - protein, 10 aa, Homo sapiens
  Native (TP53 R158L)
GTRVLAMAIY

SEQ ID NO: 19395 - protein, 11 aa, Homo sapiens
  Native (TP53 R158L)
GTRVLAMAIYK

SEQ ID NO: 19396 - protein, 9 aa, Homo sapiens
  Native (TP53 R158L)
PPGTRVLAM

SEQ ID NO: 19397 - protein, 8 aa, Homo sapiens
  Native (TP53 R158L)
RVLAMAIY

SEQ ID NO: 19398 - protein, 10 aa, Homo sapiens
  Native (TP53 R158L)
RVLAMAIYKQ

SEQ ID NO: 19399 - protein, 11 aa, Homo sapiens
  Native (TP53 R158L)
TPPPGTRVLAM

SEQ ID NO: 19400 - protein, 9 aa, Homo sapiens
  Native (TP53 R158L)
TRVLAMAIY

SEQ ID NO: 19401 - protein, 10 aa, Homo sapiens
  Native (TP53 R158L)
TRVLAMAIYK

SEQ ID NO: 19402 - protein, 9 aa, Homo sapiens
  Native (TP53 R158L)
PPPGTRVLA

SEQ ID NO: 19403 - protein, 10 aa, Homo sapiens
  Native (TP53 R158L)
PPPGTRVLAM

SEQ ID NO: 19404 - protein, 8 aa, Homo sapiens
  Native (TP53 R158L)
TRVLAMAI

SEQ ID NO: 19405 - protein, 11 aa, Artificial Sequence
  Description of Artificial Sequence: Synthetic peptide
  Seed: EVVRHCPHHER (TP53 R175H)
EAVRHCPHHEK

SEQ ID NO: 19406 - protein, 11 aa, Artificial Sequence
  Description of Artificial Sequence: Synthetic peptide
  Seed: EVVRHCPHHER (TP53 R175H)
EAVRHCPHHER

SEQ ID NO: 19407 - protein, 11 aa, Artificial Sequence
  Description of Artificial Sequence: Synthetic peptide
  Seed: EVVRHCPHHER (TP53 R175H)
EFVRHCPHHER

SEQ ID NO: 19408 - protein, 11 aa, Artificial Sequence
  Description of Artificial Sequence: Synthetic peptide
  Seed: EVVRHCPHHER (TP53 R175H)
EHVRHCPHHER

SEQ ID NO: 19409 - protein, 11 aa, Artificial Sequence
  Description of Artificial Sequence: Synthetic peptide
  Seed: EVVRHCPHHER (TP53 R175H)
EIVRHCPHHEK

SEQ ID NO: 19410 - protein, 11 aa, Artificial Sequence
  Description of Artificial Sequence: Synthetic peptide
  Seed: EVVRHCPHHER (TP53 R175H)
EIVRHCPHHER

SEQ ID NO: 19411 - protein, 11 aa, Artificial Sequence
  Description of Artificial Sequence: Synthetic peptide
  Seed: EVVRHCPHHER (TP53 R175H)
EKVRHCPHHER

SEQ ID NO: 19412 - protein, 11 aa, Artificial Sequence
  Description of Artificial Sequence: Synthetic peptide
  Seed: EVVRHCPHHER (TP53 R175H)
ELVRHCPHHER

SEQ ID NO: 19413 - protein, 11 aa, Artificial Sequence
  Description of Artificial Sequence: Synthetic peptide
  Seed: EVVRHCPHHER (TP53 R175H)
EMVRHCPHHER

SEQ ID NO: 19414 - protein, 11 aa, Artificial Sequence
  Description of Artificial Sequence: Synthetic peptide
  Seed: EVVRHCPHHER (TP53 R175H)
ENVRHCPHHER

SEQ ID NO: 19415 - protein, 11 aa, Artificial Sequence
  Description of Artificial Sequence: Synthetic peptide
  Seed: EVVRHCPHHER (TP53 R175H)
ERVRHCPHHER

SEQ ID NO: 19416 - protein, 11 aa, Artificial Sequence
  Description of Artificial Sequence: Synthetic peptide
  Seed: EVVRHCPHHER (TP53 R175H)
ESVRHCPHHEK

SEQ ID NO: 19417 - protein, 11 aa, Artificial Sequence
  Description of Artificial Sequence: Synthetic peptide
  Seed: EVVRHCPHHER (TP53 R175H)
ESVRHCPHHER

SEQ ID NO: 19418 - protein, 11 aa, Artificial Sequence
  Description of Artificial Sequence: Synthetic peptide
  Seed: EVVRHCPHHER (TP53 R175H)
ETVRHCPHHEK

SEQ ID NO: 19419 - protein, 11 aa, Artificial Sequence
  Description of Artificial Sequence: Synthetic peptide
  Seed: EVVRHCPHHER (TP53 R175H)
EVVRHCPHHEK

SEQ ID NO: 19420 - protein, 11 aa, Artificial Sequence
  Description of Artificial Sequence: Synthetic peptide
  Seed: EVVRHCPHHER (TP53 R175H)
EWVRHCPHHER

SEQ ID NO: 19421 - protein, 11 aa, Artificial Sequence
  Description of Artificial Sequence: Synthetic peptide
  Seed: EVVRHCPHHER (TP53 R175H)
EYVRHCPHHER

SEQ ID NO: 19422 - protein, 10 aa, Artificial Sequence
  Description of Artificial Sequence: Synthetic peptide
  Seed: VVRHCPHHER (TP53 R175H)
VARHCPHHER

SEQ ID NO: 19423 - protein, 10 aa, Artificial Sequence
  Description of Artificial Sequence: Synthetic peptide
  Seed: VVRHCPHHER (TP53 R175H)
VFRHCPHHEK

SEQ ID NO: 19424 - protein, 10 aa, Artificial Sequence
  Description of Artificial Sequence: Synthetic peptide
  Seed: VVRHCPHHER (TP53 R175H)
VFRHCPHHER

SEQ ID NO: 19425 - protein, 10 aa, Artificial Sequence
  Description of Artificial Sequence: Synthetic peptide
  Seed: VVRHCPHHER (TP53 R175H)
VGRHCPHHER

SEQ ID NO: 19426 - protein, 10 aa, Artificial Sequence
  Description of Artificial Sequence: Synthetic peptide
  Seed: VVRHCPHHER (TP53 R175H)
VIRHCPHHEK

SEQ ID NO: 19427 - protein, 10 aa, Artificial Sequence
  Description of Artificial Sequence: Synthetic peptide
  Seed: VVRHCPHHER (TP53 R175H)
VIRHCPHHER

SEQ ID NO: 19428 - protein, 10 aa, Artificial Sequence
  Description of Artificial Sequence: Synthetic peptide
  Seed: VVRHCPHHER (TP53 R175H)
VLRHCPHHEK

SEQ ID NO: 19429 - protein, 10 aa, Artificial Sequence
  Description of Artificial Sequence: Synthetic peptide
  Seed: VVRHCPHHER (TP53 R175H)
VLRHCPHHER

SEQ ID NO: 19430 - protein, 10 aa, Artificial Sequence
  Description of Artificial Sequence: Synthetic peptide
  Seed: VVRHCPHHER (TP53 R175H)
VMRHCPHHEK

SEQ ID NO: 19431 - protein, 10 aa, Artificial Sequence
  Description of Artificial Sequence: Synthetic peptide
  Seed: VVRHCPHHER (TP53 R175H)
VNRHCPHHER

SEQ ID NO: 19432 - protein, 10 aa, Artificial Sequence
  Description of Artificial Sequence: Synthetic peptide
  Seed: VVRHCPHHER (TP53 R175H)
VQRHCPHHEK

SEQ ID NO: 19433 - protein, 10 aa, Artificial Sequence
  Description of Artificial Sequence: Synthetic peptide
  Seed: VVRHCPHHER (TP53 R175H)
VQRHCPHHER

SEQ ID NO: 19434 - protein, 9 aa, Artificial Sequence
  Description of Artificial Sequence: Synthetic peptide
  Seed: VRHCPHHER (TP53 R175H)
VRHCPHHEK

SEQ ID NO: 19435 - protein, 10 aa, Artificial Sequence
  Description of Artificial Sequence: Synthetic peptide
  Seed: VVRHCPHHER (TP53 R175H)
VSRHCPHHEK

SEQ ID NO: 19436 - protein, 10 aa, Artificial Sequence
  Description of Artificial Sequence: Synthetic peptide
  Seed: VVRHCPHHER (TP53 R175H)
VSRHCPHHER

SEQ ID NO: 19437 - protein, 10 aa, Artificial Sequence
  Description of Artificial Sequence: Synthetic peptide
  Seed: VVRHCPHHER (TP53 R175H)
VTRHCPHHEK

SEQ ID NO: 19438 - protein, 10 aa, Artificial Sequence
  Description of Artificial Sequence: Synthetic peptide
  Seed: VVRHCPHHER (TP53 R175H)
VVRHCPHHEK

SEQ ID NO: 19439 - protein, 10 aa, Artificial Sequence
  Description of Artificial Sequence: Synthetic peptide
  Seed: VVRHCPHHER (TP53 R175H)
VWRHCPHHEK

SEQ ID NO: 19440 - protein, 10 aa, Artificial Sequence
  Description of Artificial Sequence: Synthetic peptide
  Seed: VVRHCPHHER (TP53 R175H)
VWRHCPHHER

SEQ ID NO: 19441 - protein, 10 aa, Artificial Sequence
  Description of Artificial Sequence: Synthetic peptide
  Seed: VVRHCPHHER (TP53 R175H)
VYRHCPHHEK

SEQ ID NO: 19442 - protein, 10 aa, Artificial Sequence
  Description of Artificial Sequence: Synthetic peptide
  Seed: VVRHCPHHER (TP53 R175H)
VYRHCPHHER

SEQ ID NO: 19443 - protein, 9 aa, Artificial Sequence
  Description of Artificial Sequence: Synthetic peptide
  Seed: EVVRHCPHH (TP53 R175H)
EAVRHCPHF

SEQ ID NO: 19444 - protein, 9 aa, Artificial Sequence
  Description of Artificial Sequence: Synthetic peptide
  Seed: EVVRHCPHH (TP53 R175H)
EAVRHCPHH

SEQ ID NO: 19445 - protein, 9 aa, Artificial Sequence
  Description of Artificial Sequence: Synthetic peptide
  Seed: EVVRHCPHH (TP53 R175H)
EAVRHCPHK

SEQ ID NO: 19446 - protein, 9 aa, Artificial Sequence
  Description of Artificial Sequence: Synthetic peptide
  Seed: EVVRHCPHH (TP53 R175H)
EAVRHCPHL

SEQ ID NO: 19447 - protein, 9 aa, Artificial Sequence
  Description of Artificial Sequence: Synthetic peptide
  Seed: EVVRHCPHH (TP53 R175H)
EAVRHCPHM

SEQ ID NO: 19448 - protein, 9 aa, Artificial Sequence
  Description of Artificial Sequence: Synthetic peptide
  Seed: EVVRHCPHH (TP53 R175H)
EAVRHCPHR

SEQ ID NO: 19449 - protein, 9 aa, Artificial Sequence
  Description of Artificial Sequence: Synthetic peptide
  Seed: EVVRHCPHH (TP53 R175H)
EAVRHCPHV

SEQ ID NO: 19450 - protein, 9 aa, Artificial Sequence
  Description of Artificial Sequence: Synthetic peptide
  Seed: EVVRHCPHH (TP53 R175H)
EAVRHCPHY

SEQ ID NO: 19451 - protein, 9 aa, Artificial Sequence
  Description of Artificial Sequence: Synthetic peptide
  Seed: EVVRHCPHH (TP53 R175H)
ECVRHCPHK

SEQ ID NO: 19452 - protein, 9 aa, Artificial Sequence
  Description of Artificial Sequence: Synthetic peptide
  Seed: EVVRHCPHH (TP53 R175H)
ECVRHCPHR

SEQ ID NO: 19453 - protein, 9 aa, Artificial Sequence
  Description of Artificial Sequence: Synthetic peptide
  Seed: EVVRHCPHH (TP53 R175H)
EDVRHCPHK

SEQ ID NO: 19454 - protein, 9 aa, Artificial Sequence
  Description of Artificial Sequence: Synthetic peptide
  Seed: EVVRHCPHH (TP53 R175H)
EDVRHCPHR

SEQ ID NO: 19455 - protein, 9 aa, Artificial Sequence
  Description of Artificial Sequence: Synthetic peptide
  Seed: EVVRHCPHH (TP53 R175H)
EEVRHCPHK

SEQ ID NO: 19456 - protein, 9 aa, Artificial Sequence
  Description of Artificial Sequence: Synthetic peptide
  Seed: EVVRHCPHH (TP53 R175H)
EEVRHCPHR

SEQ ID NO: 19457 - protein, 11 aa, Artificial Sequence
  Description of Artificial Sequence: Synthetic peptide
  Seed: EVVRHCPHHER (TP53 R175H)
EFVRHCPHHEK

SEQ ID NO: 19458 - protein, 9 aa, Artificial Sequence
  Description of Artificial Sequence: Synthetic peptide
  Seed: EVVRHCPHH (TP53 R175H)
EFVRHCPHK

SEQ ID NO: 19459 - protein, 9 aa, Artificial Sequence
  Description of Artificial Sequence: Synthetic peptide
  Seed: EVVRHCPHH (TP53 R175H)
EFVRHCPHR

SEQ ID NO: 19460 - protein, 11 aa, Artificial Sequence
  Description of Artificial Sequence: Synthetic peptide
  Seed: EVVRHCPHHER (TP53 R175H)
EGVRHCPHHER

SEQ ID NO: 19461 - protein, 9 aa, Artificial Sequence
  Description of Artificial Sequence: Synthetic peptide
  Seed: EVVRHCPHH (TP53 R175H)
EGVRHCPHK

SEQ ID NO: 19462 - protein, 9 aa, Artificial Sequence
  Description of Artificial Sequence: Synthetic peptide
  Seed: EVVRHCPHH (TP53 R175H)
EGVRHCPHR

SEQ ID NO: 19463 - protein, 9 aa, Artificial Sequence
  Description of Artificial Sequence: Synthetic peptide
  Seed: EVVRHCPHH (TP53 R175H)
EIVRHCPHF

SEQ ID NO: 19464 - protein, 9 aa, Artificial Sequence
  Description of Artificial Sequence: Synthetic peptide
  Seed: EVVRHCPHH (TP53 R175H)
EIVRHCPHH

SEQ ID NO: 19465 - protein, 9 aa, Artificial Sequence
  Description of Artificial Sequence: Synthetic peptide
  Seed: EVVRHCPHH (TP53 R175H)
EIVRHCPHI

SEQ ID NO: 19466 - protein, 9 aa, Artificial Sequence
  Description of Artificial Sequence: Synthetic peptide
  Seed: EVVRHCPHH (TP53 R175H)
EIVRHCPHK

SEQ ID NO: 19467 - protein, 9 aa, Artificial Sequence
  Description of Artificial Sequence: Synthetic peptide
  Seed: EVVRHCPHH (TP53 R175H)
EIVRHCPHL

SEQ ID NO: 19468 - protein, 9 aa, Artificial Sequence
  Description of Artificial Sequence: Synthetic peptide
  Seed: EVVRHCPHH (TP53 R175H)
EIVRHCPHM

SEQ ID NO: 19469 - protein, 9 aa, Artificial Sequence
  Description of Artificial Sequence: Synthetic peptide
  Seed: EVVRHCPHH (TP53 R175H)
EIVRHCPHR

SEQ ID NO: 19470 - protein, 9 aa, Artificial Sequence
  Description of Artificial Sequence: Synthetic peptide
  Seed: EVVRHCPHH (TP53 R175H)
EIVRHCPHV

SEQ ID NO: 19471 - protein, 9 aa, Artificial Sequence
  Description of Artificial Sequence: Synthetic peptide
  Seed: EVVRHCPHH (TP53 R175H)
EIVRHCPHY

SEQ ID NO: 19472 - protein, 9 aa, Artificial Sequence
  Description of Artificial Sequence: Synthetic peptide
  Seed: EVVRHCPHH (TP53 R175H)
ELVRHCPHF

SEQ ID NO: 19473 - protein, 9 aa, Artificial Sequence
  Description of Artificial Sequence: Synthetic peptide
  Seed: EVVRHCPHH (TP53 R175H)
ELVRHCPHH

SEQ ID NO: 19474 - protein, 11 aa, Artificial Sequence
  Description of Artificial Sequence: Synthetic peptide
  Seed: EVVRHCPHHER (TP53 R175H)
ELVRHCPHHEK

SEQ ID NO: 19475 - protein, 9 aa, Artificial Sequence
  Description of Artificial Sequence: Synthetic peptide
  Seed: EVVRHCPHH (TP53 R175H)
ELVRHCPHK

SEQ ID NO: 19476 - protein, 9 aa, Artificial Sequence
  Description of Artificial Sequence: Synthetic peptide
  Seed: EVVRHCPHH (TP53 R175H)
ELVRHCPHL

SEQ ID NO: 19477 - protein, 9 aa, Artificial Sequence
  Description of Artificial Sequence: Synthetic peptide
  Seed: EVVRHCPHH (TP53 R175H)
ELVRHCPHM

SEQ ID NO: 19478 - protein, 9 aa, Artificial Sequence
  Description of Artificial Sequence: Synthetic peptide
  Seed: EVVRHCPHH (TP53 R175H)
ELVRHCPHR

SEQ ID NO: 19479 - protein, 9 aa, Artificial Sequence
  Description of Artificial Sequence: Synthetic peptide
  Seed: EVVRHCPHH (TP53 R175H)
ELVRHCPHY

SEQ ID NO: 19480 - protein, 9 aa, Artificial Sequence
  Description of Artificial Sequence: Synthetic peptide
  Seed: EVVRHCPHH (TP53 R175H)
EMVRHCPHH

SEQ ID NO: 19481 - protein, 11 aa, Artificial Sequence
  Description of Artificial Sequence: Synthetic peptide
  Seed: EVVRHCPHHER (TP53 R175H)
EMVRHCPHHEK

SEQ ID NO: 19482 - protein, 9 aa, Artificial Sequence
  Description of Artificial Sequence: Synthetic peptide
  Seed: EVVRHCPHH (TP53 R175H)
EMVRHCPHK

SEQ ID NO: 19483 - protein, 9 aa, Artificial Sequence
  Description of Artificial Sequence: Synthetic peptide
  Seed: EVVRHCPHH (TP53 R175H)
EMVRHCPHL

SEQ ID NO: 19484 - protein, 9 aa, Artificial Sequence
  Description of Artificial Sequence: Synthetic peptide
  Seed: EVVRHCPHH (TP53 R175H)
EMVRHCPHM

SEQ ID NO: 19485 - protein, 9 aa, Artificial Sequence
  Description of Artificial Sequence: Synthetic peptide
  Seed: EVVRHCPHH (TP53 R175H)
EMVRHCPHR

SEQ ID NO: 19486 - protein, 9 aa, Artificial Sequence
  Description of Artificial Sequence: Synthetic peptide
  Seed: EVVRHCPHH (TP53 R175H)
EMVRHCPHY

SEQ ID NO: 19487 - protein, 9 aa, Artificial Sequence
  Description of Artificial Sequence: Synthetic peptide
  Seed: EVVRHCPHH (TP53 R175H)
ENVRHCPHK

SEQ ID NO: 19488 - protein, 9 aa, Artificial Sequence
  Description of Artificial Sequence: Synthetic peptide
  Seed: EVVRHCPHH (TP53 R175H)
ENVRHCPHR

SEQ ID NO: 19489 - protein, 9 aa, Artificial Sequence
  Description of Artificial Sequence: Synthetic peptide
  Seed: EVVRHCPHH (TP53 R175H)
EPVRHCPHK

SEQ ID NO: 19490 - protein, 9 aa, Artificial Sequence
  Description of Artificial Sequence: Synthetic peptide
  Seed: EVVRHCPHH (TP53 R175H)
EPVRHCPHR

SEQ ID NO: 19491 - protein, 11 aa, Artificial Sequence
  Description of Artificial Sequence: Synthetic peptide
  Seed: EVVRHCPHHER (TP53 R175H)
EQVRHCPHHER

SEQ ID NO: 19492 - protein, 9 aa, Artificial Sequence
  Description of Artificial Sequence: Synthetic peptide
  Seed: EVVRHCPHH (TP53 R175H)
EQVRHCPHK

SEQ ID NO: 19493 - protein, 9 aa, Artificial Sequence
  Description of Artificial Sequence: Synthetic peptide
  Seed: EVVRHCPHH (TP53 R175H)
EQVRHCPHR

SEQ ID NO: 19494 - protein, 9 aa, Artificial Sequence
  Description of Artificial Sequence: Synthetic peptide
  Seed: EVVRHCPHH (TP53 R175H)
ESVRHCPHF

SEQ ID NO: 19495 - protein, 9 aa, Artificial Sequence
  Description of Artificial Sequence: Synthetic peptide
  Seed: EVVRHCPHH (TP53 R175H)
ESVRHCPHH

SEQ ID NO: 19496 - protein, 9 aa, Artificial Sequence
  Description of Artificial Sequence: Synthetic peptide
  Seed: EVVRHCPHH (TP53 R175H)
ESVRHCPHK

SEQ ID NO: 19497 - protein, 9 aa, Artificial Sequence
  Description of Artificial Sequence: Synthetic peptide
  Seed: EVVRHCPHH (TP53 R175H)
ESVRHCPHL

SEQ ID NO: 19498 - protein, 9 aa, Artificial Sequence
  Description of Artificial Sequence: Synthetic peptide
  Seed: EVVRHCPHH (TP53 R175H)
ESVRHCPHM

SEQ ID NO: 19499 - protein, 9 aa, Artificial Sequence
  Description of Artificial Sequence: Synthetic peptide
  Seed: EVVRHCPHH (TP53 R175H)
ESVRHCPHR

SEQ ID NO: 19500 - protein, 9 aa, Artificial Sequence
  Description of Artificial Sequence: Synthetic peptide
  Seed: EVVRHCPHH (TP53 R175H)
ESVRHCPHY

SEQ ID NO: 19501 - protein, 9 aa, Artificial Sequence
  Description of Artificial Sequence: Synthetic peptide
  Seed: EVVRHCPHH (TP53 R175H)
ETVRHCPHF

SEQ ID NO: 19502 - protein, 9 aa, Artificial Sequence
  Description of Artificial Sequence: Synthetic peptide
  Seed: EVVRHCPHH (TP53 R175H)
ETVRHCPHH

SEQ ID NO: 19503 - protein, 9 aa, Artificial Sequence
  Description of Artificial Sequence: Synthetic peptide
  Seed: EVVRHCPHH (TP53 R175H)
ETVRHCPHI

SEQ ID NO: 19504 - protein, 9 aa, Artificial Sequence
  Description of Artificial Sequence: Synthetic peptide
  Seed: EVVRHCPHH (TP53 R175H)
ETVRHCPHK

SEQ ID NO: 19505 - protein, 9 aa, Artificial Sequence
  Description of Artificial Sequence: Synthetic peptide
  Seed: EVVRHCPHH (TP53 R175H)
ETVRHCPHL

SEQ ID NO: 19506 - protein, 9 aa, Artificial Sequence
  Description of Artificial Sequence: Synthetic peptide
  Seed: EVVRHCPHH (TP53 R175H)
ETVRHCPHM

SEQ ID NO: 19507 - protein, 9 aa, Artificial Sequence
  Description of Artificial Sequence: Synthetic peptide
  Seed: EVVRHCPHH (TP53 R175H)
ETVRHCPHR

SEQ ID NO: 19508 - protein, 9 aa, Artificial Sequence
  Description of Artificial Sequence: Synthetic peptide
  Seed: EVVRHCPHH (TP53 R175H)
ETVRHCPHV

SEQ ID NO: 19509 - protein, 9 aa, Artificial Sequence
  Description of Artificial Sequence: Synthetic peptide
  Seed: EVVRHCPHH (TP53 R175H)
ETVRHCPHY

SEQ ID NO: 19510 - protein, 9 aa, Artificial Sequence
  Description of Artificial Sequence: Synthetic peptide
  Seed: EVVRHCPHH (TP53 R175H)
EVVRHCPHA

SEQ ID NO: 19511 - protein, 9 aa, Artificial Sequence
  Description of Artificial Sequence: Synthetic peptide
  Seed: EVVRHCPHH (TP53 R175H)
EVVRHCPHF

SEQ ID NO: 19512 - protein, 9 aa, Artificial Sequence
  Description of Artificial Sequence: Synthetic peptide
  Seed: EVVRHCPHH (TP53 R175H)
EVVRHCPHI

SEQ ID NO: 19513 - protein, 9 aa, Artificial Sequence
  Description of Artificial Sequence: Synthetic peptide
  Seed: EVVRHCPHH (TP53 R175H)
EVVRHCPHK

SEQ ID NO: 19514 - protein, 9 aa, Artificial Sequence
  Description of Artificial Sequence: Synthetic peptide
  Seed: EVVRHCPHH (TP53 R175H)
EVVRHCPHL

SEQ ID NO: 19515 - protein, 9 aa, Artificial Sequence
  Description of Artificial Sequence: Synthetic peptide
  Seed: EVVRHCPHH (TP53 R175H)
EVVRHCPHM

SEQ ID NO: 19516 - protein, 9 aa, Artificial Sequence
  Description of Artificial Sequence: Synthetic peptide
  Seed: EVVRHCPHH (TP53 R175H)
EVVRHCPHV

SEQ ID NO: 19517 - protein, 9 aa, Artificial Sequence
  Description of Artificial Sequence: Synthetic peptide
  Seed: EVVRHCPHH (TP53 R175H)
EVVRHCPHY

SEQ ID NO: 19518 - protein, 11 aa, Artificial Sequence
  Description of Artificial Sequence: Synthetic peptide
  Seed: EVVRHCPHHER (TP53 R175H)
EYVRHCPHHEK

SEQ ID NO: 19519 - protein, 9 aa, Artificial Sequence
  Description of Artificial Sequence: Synthetic peptide
  Seed: EVVRHCPHH (TP53 R175H)
EYVRHCPHK

SEQ ID NO: 19520 - protein, 9 aa, Artificial Sequence
  Description of Artificial Sequence: Synthetic peptide
  Seed: EVVRHCPHH (TP53 R175H)
EYVRHCPHR

SEQ ID NO: 19521 - protein, 9 aa, Artificial Sequence
  Description of Artificial Sequence: Synthetic peptide
  Seed: HMTEVVRHC (TP53 R175H)
HATEVVRHF

SEQ ID NO: 19522 - protein, 9 aa, Artificial Sequence
  Description of Artificial Sequence: Synthetic peptide
  Seed: HMTEVVRHC (TP53 R175H)
HATEVVRHI

SEQ ID NO: 19523 - protein, 9 aa, Artificial Sequence
  Description of Artificial Sequence: Synthetic peptide
  Seed: HMTEVVRHC (TP53 R175H)
HATEVVRHL

SEQ ID NO: 19524 - protein, 9 aa, Artificial Sequence
  Description of Artificial Sequence: Synthetic peptide
  Seed: HMTEVVRHC (TP53 R175H)
HATEVVRHM

SEQ ID NO: 19525 - protein, 9 aa, Artificial Sequence
  Description of Artificial Sequence: Synthetic peptide
  Seed: HMTEVVRHC (TP53 R175H)
HATEVVRHV

SEQ ID NO: 19526 - protein, 9 aa, Artificial Sequence
  Description of Artificial Sequence: Synthetic peptide
  Seed: HMTEVVRHC (TP53 R175H)
HATEVVRHW

SEQ ID NO: 19527 - protein, 9 aa, Artificial Sequence
  Description of Artificial Sequence: Synthetic peptide
  Seed: HMTEVVRHC (TP53 R175H)
HDTEVVRHF

SEQ ID NO: 19528 - protein, 9 aa, Artificial Sequence
  Description of Artificial Sequence: Synthetic peptide
  Seed: HMTEVVRHC (TP53 R175H)
HDTEVVRHI

SEQ ID NO: 19529 - protein, 9 aa, Artificial Sequence
  Description of Artificial Sequence: Synthetic peptide
  Seed: HMTEVVRHC (TP53 R175H)
HDTEVVRHL

SEQ ID NO: 19530 - protein, 9 aa, Artificial Sequence
  Description of Artificial Sequence: Synthetic peptide
  Seed: HMTEVVRHC (TP53 R175H)
HDTEVVRHV

SEQ ID NO: 19531 - protein, 9 aa, Artificial Sequence
  Description of Artificial Sequence: Synthetic peptide
  Seed: HMTEVVRHC (TP53 R175H)
HETEVVRHF

SEQ ID NO: 19532 - protein, 9 aa, Artificial Sequence
  Description of Artificial Sequence: Synthetic peptide
  Seed: HMTEVVRHC (TP53 R175H)
HETEVVRHI

SEQ ID NO: 19533 - protein, 9 aa, Artificial Sequence
  Description of Artificial Sequence: Synthetic peptide
  Seed: HMTEVVRHC (TP53 R175H)
HETEVVRHL

SEQ ID NO: 19534 - protein, 9 aa, Artificial Sequence
  Description of Artificial Sequence: Synthetic peptide
  Seed: HMTEVVRHC (TP53 R175H)
HETEVVRHM

SEQ ID NO: 19535 - protein, 9 aa, Artificial Sequence
  Description of Artificial Sequence: Synthetic peptide
  Seed: HMTEVVRHC (TP53 R175H)
HETEVVRHV

SEQ ID NO: 19536 - protein, 9 aa, Artificial Sequence
  Description of Artificial Sequence: Synthetic peptide
  Seed: HMTEVVRHC (TP53 R175H)
HETEVVRHW

SEQ ID NO: 19537 - protein, 9 aa, Artificial Sequence
  Description of Artificial Sequence: Synthetic peptide
  Seed: HMTEVVRHC (TP53 R175H)
HFTEVVRHV

SEQ ID NO: 19538 - protein, 9 aa, Artificial Sequence
  Description of Artificial Sequence: Synthetic peptide
  Seed: HMTEVVRHC (TP53 R175H)
HGTEVVRHF

SEQ ID NO: 19539 - protein, 9 aa, Artificial Sequence
  Description of Artificial Sequence: Synthetic peptide
  Seed: HMTEVVRHC (TP53 R175H)
HGTEVVRHI

SEQ ID NO: 19540 - protein, 9 aa, Artificial Sequence
  Description of Artificial Sequence: Synthetic peptide
  Seed: HMTEVVRHC (TP53 R175H)
HGTEVVRHL

SEQ ID NO: 19541 - protein, 9 aa, Artificial Sequence
  Description of Artificial Sequence: Synthetic peptide
  Seed: HMTEVVRHC (TP53 R175H)
HGTEVVRHV

SEQ ID NO: 19542 - protein, 9 aa, Artificial Sequence
  Description of Artificial Sequence: Synthetic peptide
  Seed: HMTEVVRHC (TP53 R175H)
HHTEVVRHF

SEQ ID NO: 19543 - protein, 9 aa, Artificial Sequence
  Description of Artificial Sequence: Synthetic peptide
  Seed: HMTEVVRHC (TP53 R175H)
HHTEVVRHI

SEQ ID NO: 19544 - protein, 9 aa, Artificial Sequence
  Description of Artificial Sequence: Synthetic peptide
  Seed: HMTEVVRHC (TP53 R175H)
HHTEVVRHL

SEQ ID NO: 19545 - protein, 9 aa, Artificial Sequence
  Description of Artificial Sequence: Synthetic peptide
  Seed: HMTEVVRHC (TP53 R175H)
HHTEVVRHV

SEQ ID NO: 19546 - protein, 9 aa, Artificial Sequence
  Description of Artificial Sequence: Synthetic peptide
  Seed: HMTEVVRHC (TP53 R175H)
HITEVVRHA

SEQ ID NO: 19547 - protein, 9 aa, Artificial Sequence
  Description of Artificial Sequence: Synthetic peptide
  Seed: HMTEVVRHC (TP53 R175H)
HITEVVRHF

SEQ ID NO: 19548 - protein, 9 aa, Artificial Sequence
  Description of Artificial Sequence: Synthetic peptide
  Seed: HMTEVVRHC (TP53 R175H)
HITEVVRHI

SEQ ID NO: 19549 - protein, 9 aa, Artificial Sequence
  Description of Artificial Sequence: Synthetic peptide
  Seed: HMTEVVRHC (TP53 R175H)
HITEVVRHL

SEQ ID NO: 19550 - protein, 9 aa, Artificial Sequence
  Description of Artificial Sequence: Synthetic peptide
  Seed: HMTEVVRHC (TP53 R175H)
HITEVVRHM

SEQ ID NO: 19551 - protein, 9 aa, Artificial Sequence
  Description of Artificial Sequence: Synthetic peptide
  Seed: HMTEVVRHC (TP53 R175H)
HITEVVRHV

SEQ ID NO: 19552 - protein, 9 aa, Artificial Sequence
  Description of Artificial Sequence: Synthetic peptide
  Seed: HMTEVVRHC (TP53 R175H)
HITEVVRHW

SEQ ID NO: 19553 - protein, 9 aa, Artificial Sequence
  Description of Artificial Sequence: Synthetic peptide
  Seed: HMTEVVRHC (TP53 R175H)
HKTEVVRHI

SEQ ID NO: 19554 - protein, 9 aa, Artificial Sequence
  Description of Artificial Sequence: Synthetic peptide
  Seed: HMTEVVRHC (TP53 R175H)
HKTEVVRHV

SEQ ID NO: 19555 - protein, 9 aa, Artificial Sequence
  Description of Artificial Sequence: Synthetic peptide
  Seed: HMTEVVRHC (TP53 R175H)
HLTEVVRHA

SEQ ID NO: 19556 - protein, 9 aa, Artificial Sequence
  Description of Artificial Sequence: Synthetic peptide
  Seed: HMTEVVRHC (TP53 R175H)
HLTEVVRHC

SEQ ID NO: 19557 - protein, 9 aa, Artificial Sequence
  Description of Artificial Sequence: Synthetic peptide
  Seed: HMTEVVRHC (TP53 R175H)
HLTEVVRHF

SEQ ID NO: 19558 - protein, 9 aa, Artificial Sequence
  Description of Artificial Sequence: Synthetic peptide
  Seed: HMTEVVRHC (TP53 R175H)
HLTEVVRHI

SEQ ID NO: 19559 - protein, 9 aa, Artificial Sequence
  Description of Artificial Sequence: Synthetic peptide
  Seed: HMTEVVRHC (TP53 R175H)
HLTEVVRHL

SEQ ID NO: 19560 - protein, 9 aa, Artificial Sequence
  Description of Artificial Sequence: Synthetic peptide
  Seed: HMTEVVRHC (TP53 R175H)
HLTEVVRHM

SEQ ID NO: 19561 - protein, 9 aa, Artificial Sequence
  Description of Artificial Sequence: Synthetic peptide
  Seed: HMTEVVRHC (TP53 R175H)
HLTEVVRHT

SEQ ID NO: 19562 - protein, 9 aa, Artificial Sequence
  Description of Artificial Sequence: Synthetic peptide
  Seed: HMTEVVRHC (TP53 R175H)
HLTEVVRHV

SEQ ID NO: 19563 - protein, 9 aa, Artificial Sequence
  Description of Artificial Sequence: Synthetic peptide
  Seed: HMTEVVRHC (TP53 R175H)
HLTEVVRHW

SEQ ID NO: 19564 - protein, 9 aa, Artificial Sequence
  Description of Artificial Sequence: Synthetic peptide
  Seed: HMTEVVRHC (TP53 R175H)
HLTEVVRHY

SEQ ID NO: 19565 - protein, 9 aa, Artificial Sequence
  Description of Artificial Sequence: Synthetic peptide
  Seed: HMTEVVRHC (TP53 R175H)
HMTEVVRHA

SEQ ID NO: 19566 - protein, 9 aa, Artificial Sequence
  Description of Artificial Sequence: Synthetic peptide
  Seed: HMTEVVRHC (TP53 R175H)
HMTEVVRHF

SEQ ID NO: 19567 - protein, 9 aa, Artificial Sequence
  Description of Artificial Sequence: Synthetic peptide
  Seed: HMTEVVRHC (TP53 R175H)
HMTEVVRHI

SEQ ID NO: 19568 - protein, 9 aa, Artificial Sequence
  Description of Artificial Sequence: Synthetic peptide
  Seed: HMTEVVRHC (TP53 R175H)
HMTEVVRHL

SEQ ID NO: 19569 - protein, 9 aa, Artificial Sequence
  Description of Artificial Sequence: Synthetic peptide
  Seed: HMTEVVRHC (TP53 R175H)
HMTEVVRHM

SEQ ID NO: 19570 - protein, 9 aa, Artificial Sequence
  Description of Artificial Sequence: Synthetic peptide
  Seed: HMTEVVRHC (TP53 R175H)
HMTEVVRHT

SEQ ID NO: 19571 - protein, 9 aa, Artificial Sequence
  Description of Artificial Sequence: Synthetic peptide
  Seed: HMTEVVRHC (TP53 R175H)
HMTEVVRHV

SEQ ID NO: 19572 - protein, 9 aa, Artificial Sequence
  Description of Artificial Sequence: Synthetic peptide
  Seed: HMTEVVRHC (TP53 R175H)
HMTEVVRHW

SEQ ID NO: 19573 - protein, 9 aa, Artificial Sequence
  Description of Artificial Sequence: Synthetic peptide
  Seed: HMTEVVRHC (TP53 R175H)
HMTEVVRHY

SEQ ID NO: 19574 - protein, 9 aa, Artificial Sequence
  Description of Artificial Sequence: Synthetic peptide
  Seed: HMTEVVRHC (TP53 R175H)
HNTEVVRHF

SEQ ID NO: 19575 - protein, 9 aa, Artificial Sequence
  Description of Artificial Sequence: Synthetic peptide
  Seed: HMTEVVRHC (TP53 R175H)
HNTEVVRHI

SEQ ID NO: 19576 - protein, 9 aa, Artificial Sequence
  Description of Artificial Sequence: Synthetic peptide
  Seed: HMTEVVRHC (TP53 R175H)
HNTEVVRHL

SEQ ID NO: 19577 - protein, 9 aa, Artificial Sequence
  Description of Artificial Sequence: Synthetic peptide
  Seed: HMTEVVRHC (TP53 R175H)
HNTEVVRHV

SEQ ID NO: 19578 - protein, 9 aa, Artificial Sequence
  Description of Artificial Sequence: Synthetic peptide
  Seed: HMTEVVRHC (TP53 R175H)
HNTEVVRHW

SEQ ID NO: 19579 - protein, 9 aa, Artificial Sequence
  Description of Artificial Sequence: Synthetic peptide
  Seed: HMTEVVRHC (TP53 R175H)
HPTEVVRHV

SEQ ID NO: 19580 - protein, 9 aa, Artificial Sequence
  Description of Artificial Sequence: Synthetic peptide
  Seed: HMTEVVRHC (TP53 R175H)
HQTEVVRHA

SEQ ID NO: 19581 - protein, 9 aa, Artificial Sequence
  Description of Artificial Sequence: Synthetic peptide
  Seed: HMTEVVRHC (TP53 R175H)
HQTEVVRHC

SEQ ID NO: 19582 - protein, 9 aa, Artificial Sequence
  Description of Artificial Sequence: Synthetic peptide
  Seed: HMTEVVRHC (TP53 R175H)
HQTEVVRHF

SEQ ID NO: 19583 - protein, 9 aa, Artificial Sequence
  Description of Artificial Sequence: Synthetic peptide
  Seed: HMTEVVRHC (TP53 R175H)
HQTEVVRHI

SEQ ID NO: 19584 - protein, 9 aa, Artificial Sequence
  Description of Artificial Sequence: Synthetic peptide
  Seed: HMTEVVRHC (TP53 R175H)
HQTEVVRHM

SEQ ID NO: 19585 - protein, 9 aa, Artificial Sequence
  Description of Artificial Sequence: Synthetic peptide
  Seed: HMTEVVRHC (TP53 R175H)
HQTEVVRHT

SEQ ID NO: 19586 - protein, 9 aa, Artificial Sequence
  Description of Artificial Sequence: Synthetic peptide
  Seed: HMTEVVRHC (TP53 R175H)
HQTEVVRHW

SEQ ID NO: 19587 - protein, 9 aa, Artificial Sequence
  Description of Artificial Sequence: Synthetic peptide
  Seed: HMTEVVRHC (TP53 R175H)
HQTEVVRHY

SEQ ID NO: 19588 - protein, 9 aa, Artificial Sequence
  Description of Artificial Sequence: Synthetic peptide
  Seed: HMTEVVRHC (TP53 R175H)
HSTEVVRHF

SEQ ID NO: 19589 - protein, 9 aa, Artificial Sequence
  Description of Artificial Sequence: Synthetic peptide
  Seed: HMTEVVRHC (TP53 R175H)
HSTEVVRHI

SEQ ID NO: 19590 - protein, 9 aa, Artificial Sequence
  Description of Artificial Sequence: Synthetic peptide
  Seed: HMTEVVRHC (TP53 R175H)
HSTEVVRHL

SEQ ID NO: 19591 - protein, 9 aa, Artificial Sequence
  Description of Artificial Sequence: Synthetic peptide
  Seed: HMTEVVRHC (TP53 R175H)
HSTEVVRHM

SEQ ID NO: 19592 - protein, 9 aa, Artificial Sequence
  Description of Artificial Sequence: Synthetic peptide
  Seed: HMTEVVRHC (TP53 R175H)
HSTEVVRHV

SEQ ID NO: 19593 - protein, 9 aa, Artificial Sequence
  Description of Artificial Sequence: Synthetic peptide
  Seed: HMTEVVRHC (TP53 R175H)
HSTEVVRHW

SEQ ID NO: 19594 - protein, 9 aa, Artificial Sequence
  Description of Artificial Sequence: Synthetic peptide
  Seed: HMTEVVRHC (TP53 R175H)
HTTEVVRHA

SEQ ID NO: 19595 - protein, 9 aa, Artificial Sequence
  Description of Artificial Sequence: Synthetic peptide
  Seed: HMTEVVRHC (TP53 R175H)
HTTEVVRHF

SEQ ID NO: 19596 - protein, 9 aa, Artificial Sequence
  Description of Artificial Sequence: Synthetic peptide
  Seed: HMTEVVRHC (TP53 R175H)
HTTEVVRHI

SEQ ID NO: 19597 - protein, 9 aa, Artificial Sequence
  Description of Artificial Sequence: Synthetic peptide
  Seed: HMTEVVRHC (TP53 R175H)
HTTEVVRHL

SEQ ID NO: 19598 - protein, 9 aa, Artificial Sequence
  Description of Artificial Sequence: Synthetic peptide
  Seed: HMTEVVRHC (TP53 R175H)
HTTEVVRHM

SEQ ID NO: 19599 - protein, 9 aa, Artificial Sequence
  Description of Artificial Sequence: Synthetic peptide
  Seed: HMTEVVRHC (TP53 R175H)
HTTEVVRHV

SEQ ID NO: 19600 - protein, 9 aa, Artificial Sequence
  Description of Artificial Sequence: Synthetic peptide
  Seed: HMTEVVRHC (TP53 R175H)
HTTEVVRHW

SEQ ID NO: 19601 - protein, 9 aa, Artificial Sequence
  Description of Artificial Sequence: Synthetic peptide
  Seed: HMTEVVRHC (TP53 R175H)
HVTEVVRHA

SEQ ID NO: 19602 - protein, 9 aa, Artificial Sequence
  Description of Artificial Sequence: Synthetic peptide
  Seed: HMTEVVRHC (TP53 R175H)
HVTEVVRHF

SEQ ID NO: 19603 - protein, 9 aa, Artificial Sequence
  Description of Artificial Sequence: Synthetic peptide
  Seed: HMTEVVRHC (TP53 R175H)
HVTEVVRHI

SEQ ID NO: 19604 - protein, 9 aa, Artificial Sequence
  Description of Artificial Sequence: Synthetic peptide
  Seed: HMTEVVRHC (TP53 R175H)
HVTEVVRHL

SEQ ID NO: 19605 - protein, 9 aa, Artificial Sequence
  Description of Artificial Sequence: Synthetic peptide
  Seed: HMTEVVRHC (TP53 R175H)
HVTEVVRHM

SEQ ID NO: 19606 - protein, 9 aa, Artificial Sequence
  Description of Artificial Sequence: Synthetic peptide
  Seed: HMTEVVRHC (TP53 R175H)
HVTEVVRHV

SEQ ID NO: 19607 - protein, 9 aa, Artificial Sequence
  Description of Artificial Sequence: Synthetic peptide
  Seed: HMTEVVRHC (TP53 R175H)
HVTEVVRHW

SEQ ID NO: 19608 - protein, 10 aa, Artificial Sequence
  Description of Artificial Sequence: Synthetic peptide
  Seed: QHMTEVVRHC (TP53 R175H)
QHMTEVVRHA

SEQ ID NO: 19609 - protein, 10 aa, Artificial Sequence
  Description of Artificial Sequence: Synthetic peptide
  Seed: QHMTEVVRHC (TP53 R175H)
QHMTEVVRHF

SEQ ID NO: 19610 - protein, 10 aa, Artificial Sequence
  Description of Artificial Sequence: Synthetic peptide
  Seed: QHMTEVVRHC (TP53 R175H)
QHMTEVVRHI

SEQ ID NO: 19611 - protein, 10 aa, Artificial Sequence
  Description of Artificial Sequence: Synthetic peptide
  Seed: QHMTEVVRHC (TP53 R175H)
QHMTEVVRHM

SEQ ID NO: 19612 - protein, 10 aa, Artificial Sequence
  Description of Artificial Sequence: Synthetic peptide
  Seed: QHMTEVVRHC (TP53 R175H)
QHMTEVVRHV

SEQ ID NO: 19613 - protein, 10 aa, Artificial Sequence
  Description of Artificial Sequence: Synthetic peptide
  Seed: QHMTEVVRHC (TP53 R175H)
QHMTEVVRHW

SEQ ID NO: 19614 - protein, 8 aa, Artificial Sequence
  Description of Artificial Sequence: Synthetic peptide
  Seed: TEVVRHCP (TP53 R175H)
TDVVRHCL

SEQ ID NO: 19615 - protein, 9 aa, Artificial Sequence
  Description of Artificial Sequence: Synthetic peptide
  Seed: TEVVRHCPH (TP53 R175H)
TDVVRHCPY

SEQ ID NO: 19616 - protein, 8 aa, Artificial Sequence
  Description of Artificial Sequence: Synthetic peptide
  Seed: TEVVRHCP (TP53 R175H)
TDVVRHCV

SEQ ID NO: 19617 - protein, 8 aa, Artificial Sequence
  Description of Artificial Sequence: Synthetic peptide
  Seed: TEVVRHCP (TP53 R175H)
TEVVRHCA

SEQ ID NO: 19618 - protein, 8 aa, Artificial Sequence
  Description of Artificial Sequence: Synthetic peptide
  Seed: TEVVRHCP (TP53 R175H)
TEVVRHCC

SEQ ID NO: 19619 - protein, 8 aa, Artificial Sequence
  Description of Artificial Sequence: Synthetic peptide
  Seed: TEVVRHCP (TP53 R175H)
TEVVRHCF

SEQ ID NO: 19620 - protein, 8 aa, Artificial Sequence
  Description of Artificial Sequence: Synthetic peptide
  Seed: TEVVRHCP (TP53 R175H)
TEVVRHCI

SEQ ID NO: 19621 - protein, 8 aa, Artificial Sequence
  Description of Artificial Sequence: Synthetic peptide
  Seed: TEVVRHCP (TP53 R175H)
TEVVRHCL

SEQ ID NO: 19622 - protein, 8 aa, Artificial Sequence
  Description of Artificial Sequence: Synthetic peptide
  Seed: TEVVRHCP (TP53 R175H)
TEVVRHCM

SEQ ID NO: 19623 - protein, 9 aa, Artificial Sequence
  Description of Artificial Sequence: Synthetic peptide
  Seed: TEVVRHCPH (TP53 R175H)
TEVVRHCPF

SEQ ID NO: 19624 - protein, 9 aa, Artificial Sequence
  Description of Artificial Sequence: Synthetic peptide
  Seed: TEVVRHCPH (TP53 R175H)
TEVVRHCPI

SEQ ID NO: 19625 - protein, 9 aa, Artificial Sequence
  Description of Artificial Sequence: Synthetic peptide
  Seed: TEVVRHCPH (TP53 R175H)
TEVVRHCPL

SEQ ID NO: 19626 - protein, 9 aa, Artificial Sequence
  Description of Artificial Sequence: Synthetic peptide
  Seed: TEVVRHCPH (TP53 R175H)
TEVVRHCPM

SEQ ID NO: 19627 - protein, 9 aa, Artificial Sequence
  Description of Artificial Sequence: Synthetic peptide
  Seed: TEVVRHCPH (TP53 R175H)
TEVVRHCPV

SEQ ID NO: 19628 - protein, 9 aa, Artificial Sequence
  Description of Artificial Sequence: Synthetic peptide
  Seed: TEVVRHCPH (TP53 R175H)
TEVVRHCPW

SEQ ID NO: 19629 - protein, 9 aa, Artificial Sequence
  Description of Artificial Sequence: Synthetic peptide
  Seed: TEVVRHCPH (TP53 R175H)
TEVVRHCPY

SEQ ID NO: 19630 - protein, 8 aa, Artificial Sequence
  Description of Artificial Sequence: Synthetic peptide
  Seed: TEVVRHCP (TP53 R175H)
TEVVRHCT

SEQ ID NO: 19631 - protein, 8 aa, Artificial Sequence
  Description of Artificial Sequence: Synthetic peptide
  Seed: TEVVRHCP (TP53 R175H)
TEVVRHCV

SEQ ID NO: 19632 - protein, 9 aa, Artificial Sequence
  Description of Artificial Sequence: Synthetic peptide
  Seed: VRHCPHHER (TP53 R175H)
VAHCPHHEF

SEQ ID NO: 19633 - protein, 9 aa, Artificial Sequence
  Description of Artificial Sequence: Synthetic peptide
  Seed: VRHCPHHER (TP53 R175H)
VAHCPHHEI

SEQ ID NO: 19634 - protein, 9 aa, Artificial Sequence
  Description of Artificial Sequence: Synthetic peptide
  Seed: VRHCPHHER (TP53 R175H)
VAHCPHHEK

SEQ ID NO: 19635 - protein, 9 aa, Artificial Sequence
  Description of Artificial Sequence: Synthetic peptide
  Seed: VRHCPHHER (TP53 R175H)
VAHCPHHEL

SEQ ID NO: 19636 - protein, 9 aa, Artificial Sequence
  Description of Artificial Sequence: Synthetic peptide
  Seed: VRHCPHHER (TP53 R175H)
VAHCPHHEM

SEQ ID NO: 19637 - protein, 9 aa, Artificial Sequence
  Description of Artificial Sequence: Synthetic peptide
  Seed: VRHCPHHER (TP53 R175H)
VAHCPHHER

SEQ ID NO: 19638 - protein, 9 aa, Artificial Sequence
  Description of Artificial Sequence: Synthetic peptide
  Seed: VRHCPHHER (TP53 R175H)
VAHCPHHEV

SEQ ID NO: 19639 - protein, 9 aa, Artificial Sequence
  Description of Artificial Sequence: Synthetic peptide
  Seed: VRHCPHHER (TP53 R175H)
VAHCPHHEY

SEQ ID NO: 19640 - protein, 10 aa, Artificial Sequence
  Description of Artificial Sequence: Synthetic peptide
  Seed: VVRHCPHHER (TP53 R175H)
VARHCPHHEK

SEQ ID NO: 19641 - protein, 9 aa, Artificial Sequence
  Description of Artificial Sequence: Synthetic peptide
  Seed: VRHCPHHER (TP53 R175H)
VCHCPHHEF

SEQ ID NO: 19642 - protein, 9 aa, Artificial Sequence
  Description of Artificial Sequence: Synthetic peptide
  Seed: VRHCPHHER (TP53 R175H)
VCHCPHHEL

SEQ ID NO: 19643 - protein, 9 aa, Artificial Sequence
  Description of Artificial Sequence: Synthetic peptide
  Seed: VRHCPHHER (TP53 R175H)
VCHCPHHER

SEQ ID NO: 19644 - protein, 9 aa, Artificial Sequence
  Description of Artificial Sequence: Synthetic peptide
  Seed: VRHCPHHER (TP53 R175H)
VDHCPHHER

SEQ ID NO: 19645 - protein, 10 aa, Artificial Sequence
  Description of Artificial Sequence: Synthetic peptide
  Seed: VVRHCPHHER (TP53 R175H)
VDRHCPHHER

SEQ ID NO: 19646 - protein, 9 aa, Artificial Sequence
  Description of Artificial Sequence: Synthetic peptide
  Seed: VRHCPHHER (TP53 R175H)
VEHCPHHEF

SEQ ID NO: 19647 - protein, 9 aa, Artificial Sequence
  Description of Artificial Sequence: Synthetic peptide
  Seed: VRHCPHHER (TP53 R175H)
VEHCPHHER

SEQ ID NO: 19648 - protein, 9 aa, Artificial Sequence
  Description of Artificial Sequence: Synthetic peptide
  Seed: VRHCPHHER (TP53 R175H)
VEHCPHHEY

SEQ ID NO: 19649 - protein, 9 aa, Artificial Sequence
  Description of Artificial Sequence: Synthetic peptide
  Seed: VRHCPHHER (TP53 R175H)
VFHCPHHEF

SEQ ID NO: 19650 - protein, 9 aa, Artificial Sequence
  Description of Artificial Sequence: Synthetic peptide
  Seed: VRHCPHHER (TP53 R175H)
VFHCPHHEI

SEQ ID NO: 19651 - protein, 9 aa, Artificial Sequence
  Description of Artificial Sequence: Synthetic peptide
  Seed: VRHCPHHER (TP53 R175H)
VFHCPHHEK

SEQ ID NO: 19652 - protein, 9 aa, Artificial Sequence
  Description of Artificial Sequence: Synthetic peptide
  Seed: VRHCPHHER (TP53 R175H)
VFHCPHHEL

SEQ ID NO: 19653 - protein, 9 aa, Artificial Sequence
  Description of Artificial Sequence: Synthetic peptide
  Seed: VRHCPHHER (TP53 R175H)
VFHCPHHEM

SEQ ID NO: 19654 - protein, 9 aa, Artificial Sequence
  Description of Artificial Sequence: Synthetic peptide
  Seed: VRHCPHHER (TP53 R175H)
VFHCPHHER

SEQ ID NO: 19655 - protein, 9 aa, Artificial Sequence
  Description of Artificial Sequence: Synthetic peptide
  Seed: VRHCPHHER (TP53 R175H)
VFHCPHHEV

SEQ ID NO: 19656 - protein, 9 aa, Artificial Sequence
  Description of Artificial Sequence: Synthetic peptide
  Seed: VRHCPHHER (TP53 R175H)
VFHCPHHEW

SEQ ID NO: 19657 - protein, 9 aa, Artificial Sequence
  Description of Artificial Sequence: Synthetic peptide
  Seed: VRHCPHHER (TP53 R175H)
VFHCPHHEY

SEQ ID NO: 19658 - protein, 9 aa, Artificial Sequence
  Description of Artificial Sequence: Synthetic peptide
  Seed: VRHCPHHER (TP53 R175H)
VGHCPHHEF

SEQ ID NO: 19659 - protein, 9 aa, Artificial Sequence
  Description of Artificial Sequence: Synthetic peptide
  Seed: VRHCPHHER (TP53 R175H)
VGHCPHHEK

SEQ ID NO: 19660 - protein, 9 aa, Artificial Sequence
  Description of Artificial Sequence: Synthetic peptide
  Seed: VRHCPHHER (TP53 R175H)
VGHCPHHEL

SEQ ID NO: 19661 - protein, 9 aa, Artificial Sequence
  Description of Artificial Sequence: Synthetic peptide
  Seed: VRHCPHHER (TP53 R175H)
VGHCPHHEM

SEQ ID NO: 19662 - protein, 9 aa, Artificial Sequence
  Description of Artificial Sequence: Synthetic peptide
  Seed: VRHCPHHER (TP53 R175H)
VGHCPHHER

SEQ ID NO: 19663 - protein, 9 aa, Artificial Sequence
  Description of Artificial Sequence: Synthetic peptide
  Seed: VRHCPHHER (TP53 R175H)
VGHCPHHEY

SEQ ID NO: 19664 - protein, 9 aa, Artificial Sequence
  Description of Artificial Sequence: Synthetic peptide
  Seed: VRHCPHHER (TP53 R175H)
VHHCPHHEF

SEQ ID NO: 19665 - protein, 9 aa, Artificial Sequence
  Description of Artificial Sequence: Synthetic peptide
  Seed: VRHCPHHER (TP53 R175H)
VHHCPHHEL

SEQ ID NO: 19666 - protein, 9 aa, Artificial Sequence
  Description of Artificial Sequence: Synthetic peptide
  Seed: VRHCPHHER (TP53 R175H)
VHHCPHHEM

SEQ ID NO: 19667 - protein, 9 aa, Artificial Sequence
  Description of Artificial Sequence: Synthetic peptide
  Seed: VRHCPHHER (TP53 R175H)
VHHCPHHER

SEQ ID NO: 19668 - protein, 9 aa, Artificial Sequence
  Description of Artificial Sequence: Synthetic peptide
  Seed: VRHCPHHER (TP53 R175H)
VHHCPHHEY

SEQ ID NO: 19669 - protein, 9 aa, Artificial Sequence
  Description of Artificial Sequence: Synthetic peptide
  Seed: VRHCPHHER (TP53 R175H)
VIHCPHHEF

SEQ ID NO: 19670 - protein, 9 aa, Artificial Sequence
  Description of Artificial Sequence: Synthetic peptide
  Seed: VRHCPHHER (TP53 R175H)
VIHCPHHEK

SEQ ID NO: 19671 - protein, 9 aa, Artificial Sequence
  Description of Artificial Sequence: Synthetic peptide
  Seed: VRHCPHHER (TP53 R175H)
VIHCPHHEL

SEQ ID NO: 19672 - protein, 9 aa, Artificial Sequence
  Description of Artificial Sequence: Synthetic peptide
  Seed: VRHCPHHER (TP53 R175H)
VIHCPHHEM

SEQ ID NO: 19673 - protein, 9 aa, Artificial Sequence
  Description of Artificial Sequence: Synthetic peptide
  Seed: VRHCPHHER (TP53 R175H)
VIHCPHHER

SEQ ID NO: 19674 - protein, 9 aa, Artificial Sequence
  Description of Artificial Sequence: Synthetic peptide
  Seed: VRHCPHHER (TP53 R175H)
VIHCPHHEY

SEQ ID NO: 19675 - protein, 9 aa, Artificial Sequence
  Description of Artificial Sequence: Synthetic peptide
  Seed: VRHCPHHER (TP53 R175H)
VKHCPHHEF

SEQ ID NO: 19676 - protein, 9 aa, Artificial Sequence
  Description of Artificial Sequence: Synthetic peptide
  Seed: VRHCPHHER (TP53 R175H)
VKHCPHHEL

SEQ ID NO: 19677 - protein, 9 aa, Artificial Sequence
  Description of Artificial Sequence: Synthetic peptide
  Seed: VRHCPHHER (TP53 R175H)
VKHCPHHEM

SEQ ID NO: 19678 - protein, 9 aa, Artificial Sequence
  Description of Artificial Sequence: Synthetic peptide
  Seed: VRHCPHHER (TP53 R175H)
VKHCPHHER

SEQ ID NO: 19679 - protein, 9 aa, Artificial Sequence
  Description of Artificial Sequence: Synthetic peptide
  Seed: VRHCPHHER (TP53 R175H)
VKHCPHHEY

SEQ ID NO: 19680 - protein, 9 aa, Artificial Sequence
  Description of Artificial Sequence: Synthetic peptide
  Seed: VRHCPHHER (TP53 R175H)
VLHCPHHEF

SEQ ID NO: 19681 - protein, 9 aa, Artificial Sequence
  Description of Artificial Sequence: Synthetic peptide
  Seed: VRHCPHHER (TP53 R175H)
VLHCPHHEK

SEQ ID NO: 19682 - protein, 9 aa, Artificial Sequence
  Description of Artificial Sequence: Synthetic peptide
  Seed: VRHCPHHER (TP53 R175H)
VLHCPHHEL

SEQ ID NO: 19683 - protein, 9 aa, Artificial Sequence
  Description of Artificial Sequence: Synthetic peptide
  Seed: VRHCPHHER (TP53 R175H)
VLHCPHHEM

SEQ ID NO: 19684 - protein, 9 aa, Artificial Sequence
  Description of Artificial Sequence: Synthetic peptide
  Seed: VRHCPHHER (TP53 R175H)
VLHCPHHER

SEQ ID NO: 19685 - protein, 9 aa, Artificial Sequence
  Description of Artificial Sequence: Synthetic peptide
  Seed: VRHCPHHER (TP53 R175H)
VLHCPHHEY

SEQ ID NO: 19686 - protein, 9 aa, Artificial Sequence
  Description of Artificial Sequence: Synthetic peptide
  Seed: VRHCPHHER (TP53 R175H)
VMHCPHHEF

SEQ ID NO: 19687 - protein, 9 aa, Artificial Sequence
  Description of Artificial Sequence: Synthetic peptide
  Seed: VRHCPHHER (TP53 R175H)
VMHCPHHEK

SEQ ID NO: 19688 - protein, 9 aa, Artificial Sequence
  Description of Artificial Sequence: Synthetic peptide
  Seed: VRHCPHHER (TP53 R175H)
VMHCPHHEL

SEQ ID NO: 19689 - protein, 9 aa, Artificial Sequence
  Description of Artificial Sequence: Synthetic peptide
  Seed: VRHCPHHER (TP53 R175H)
VMHCPHHEM

SEQ ID NO: 19690 - protein, 9 aa, Artificial Sequence
  Description of Artificial Sequence: Synthetic peptide
  Seed: VRHCPHHER (TP53 R175H)
VMHCPHHER

SEQ ID NO: 19691 - protein, 9 aa, Artificial Sequence
  Description of Artificial Sequence: Synthetic peptide
  Seed: VRHCPHHER (TP53 R175H)
VMHCPHHEY

SEQ ID NO: 19692 - protein, 9 aa, Artificial Sequence
  Description of Artificial Sequence: Synthetic peptide
  Seed: VRHCPHHER (TP53 R175H)
VNHCPHHEF

SEQ ID NO: 19693 - protein, 9 aa, Artificial Sequence
  Description of Artificial Sequence: Synthetic peptide
  Seed: VRHCPHHER (TP53 R175H)
VNHCPHHEK

SEQ ID NO: 19694 - protein, 9 aa, Artificial Sequence
  Description of Artificial Sequence: Synthetic peptide
  Seed: VRHCPHHER (TP53 R175H)
VNHCPHHEL

SEQ ID NO: 19695 - protein, 9 aa, Artificial Sequence
  Description of Artificial Sequence: Synthetic peptide
  Seed: VRHCPHHER (TP53 R175H)
VNHCPHHEM

SEQ ID NO: 19696 - protein, 9 aa, Artificial Sequence
  Description of Artificial Sequence: Synthetic peptide
  Seed: VRHCPHHER (TP53 R175H)
VNHCPHHER

SEQ ID NO: 19697 - protein, 9 aa, Artificial Sequence
  Description of Artificial Sequence: Synthetic peptide
  Seed: VRHCPHHER (TP53 R175H)
VNHCPHHEY

SEQ ID NO: 19698 - protein, 9 aa, Artificial Sequence
  Description of Artificial Sequence: Synthetic peptide
  Seed: VRHCPHHER (TP53 R175H)
VPHCPHHEF

SEQ ID NO: 19699 - protein, 9 aa, Artificial Sequence
  Description of Artificial Sequence: Synthetic peptide
  Seed: VRHCPHHER (TP53 R175H)
VPHCPHHEL

SEQ ID NO: 19700 - protein, 9 aa, Artificial Sequence
  Description of Artificial Sequence: Synthetic peptide
  Seed: VRHCPHHER (TP53 R175H)
VPHCPHHEM

SEQ ID NO: 19701 - protein, 9 aa, Artificial Sequence
  Description of Artificial Sequence: Synthetic peptide
  Seed: VRHCPHHER (TP53 R175H)
VPHCPHHER

SEQ ID NO: 19702 - protein, 9 aa, Artificial Sequence
  Description of Artificial Sequence: Synthetic peptide
  Seed: VRHCPHHER (TP53 R175H)
VPHCPHHEY

SEQ ID NO: 19703 - protein, 9 aa, Artificial Sequence
  Description of Artificial Sequence: Synthetic peptide
  Seed: VRHCPHHER (TP53 R175H)
VQHCPHHEF

SEQ ID NO: 19704 - protein, 9 aa, Artificial Sequence
  Description of Artificial Sequence: Synthetic peptide
  Seed: VRHCPHHER (TP53 R175H)
VQHCPHHEK

SEQ ID NO: 19705 - protein, 9 aa, Artificial Sequence
  Description of Artificial Sequence: Synthetic peptide
  Seed: VRHCPHHER (TP53 R175H)
VQHCPHHEL

SEQ ID NO: 19706 - protein, 9 aa, Artificial Sequence
  Description of Artificial Sequence: Synthetic peptide
  Seed: VRHCPHHER (TP53 R175H)
VQHCPHHEM

SEQ ID NO: 19707 - protein, 9 aa, Artificial Sequence
  Description of Artificial Sequence: Synthetic peptide
  Seed: VRHCPHHER (TP53 R175H)
VQHCPHHER

SEQ ID NO: 19708 - protein, 9 aa, Artificial Sequence
  Description of Artificial Sequence: Synthetic peptide
  Seed: VRHCPHHER (TP53 R175H)
VQHCPHHEY

SEQ ID NO: 19709 - protein, 9 aa, Artificial Sequence
  Description of Artificial Sequence: Synthetic peptide
  Seed: VRHCPHHER (TP53 R175H)
VRHCPHHEA

SEQ ID NO: 19710 - protein, 9 aa, Artificial Sequence
  Description of Artificial Sequence: Synthetic peptide
  Seed: VRHCPHHER (TP53 R175H)
VRHCPHHEH

SEQ ID NO: 19711 - protein, 9 aa, Artificial Sequence
  Description of Artificial Sequence: Synthetic peptide
  Seed: VRHCPHHER (TP53 R175H)
VRHCPHHEI

SEQ ID NO: 19712 - protein, 9 aa, Artificial Sequence
  Description of Artificial Sequence: Synthetic peptide
  Seed: VRHCPHHER (TP53 R175H)
VRHCPHHEL

SEQ ID NO: 19713 - protein, 9 aa, Artificial Sequence
  Description of Artificial Sequence: Synthetic peptide
  Seed: VRHCPHHER (TP53 R175H)
VRHCPHHEV

SEQ ID NO: 19714 - protein, 9 aa, Artificial Sequence
  Description of Artificial Sequence: Synthetic peptide
  Seed: VRHCPHHER (TP53 R175H)
VRHCPHHEW

SEQ ID NO: 19715 - protein, 9 aa, Artificial Sequence
  Description of Artificial Sequence: Synthetic peptide
  Seed: VRHCPHHER (TP53 R175H)
VSHCPHHEF

SEQ ID NO: 19716 - protein, 9 aa, Artificial Sequence
  Description of Artificial Sequence: Synthetic peptide
  Seed: VRHCPHHER (TP53 R175H)
VSHCPHHEK

SEQ ID NO: 19717 - protein, 9 aa, Artificial Sequence
  Description of Artificial Sequence: Synthetic peptide
  Seed: VRHCPHHER (TP53 R175H)
VSHCPHHEL

SEQ ID NO: 19718 - protein, 9 aa, Artificial Sequence
  Description of Artificial Sequence: Synthetic peptide
  Seed: VRHCPHHER (TP53 R175H)
VSHCPHHEM

SEQ ID NO: 19719 - protein, 9 aa, Artificial Sequence
  Description of Artificial Sequence: Synthetic peptide
  Seed: VRHCPHHER (TP53 R175H)
VSHCPHHER

SEQ ID NO: 19720 - protein, 9 aa, Artificial Sequence
  Description of Artificial Sequence: Synthetic peptide
  Seed: VRHCPHHER (TP53 R175H)
VSHCPHHEY

SEQ ID NO: 19721 - protein, 9 aa, Artificial Sequence
  Description of Artificial Sequence: Synthetic peptide
  Seed: VRHCPHHER (TP53 R175H)
VTHCPHHEF

SEQ ID NO: 19722 - protein, 9 aa, Artificial Sequence
  Description of Artificial Sequence: Synthetic peptide
  Seed: VRHCPHHER (TP53 R175H)
VTHCPHHEK

SEQ ID NO: 19723 - protein, 9 aa, Artificial Sequence
  Description of Artificial Sequence: Synthetic peptide
  Seed: VRHCPHHER (TP53 R175H)
VTHCPHHEL

SEQ ID NO: 19724 - protein, 9 aa, Artificial Sequence
  Description of Artificial Sequence: Synthetic peptide
  Seed: VRHCPHHER (TP53 R175H)
VTHCPHHEM

SEQ ID NO: 19725 - protein, 9 aa, Artificial Sequence
  Description of Artificial Sequence: Synthetic peptide
  Seed: VRHCPHHER (TP53 R175H)
VTHCPHHEY

SEQ ID NO: 19726 - protein, 9 aa, Artificial Sequence
  Description of Artificial Sequence: Synthetic peptide
  Seed: VRHCPHHER (TP53 R175H)
VVHCPHHEF

SEQ ID NO: 19727 - protein, 9 aa, Artificial Sequence
  Description of Artificial Sequence: Synthetic peptide
  Seed: VRHCPHHER (TP53 R175H)
VVHCPHHEK

SEQ ID NO: 19728 - protein, 9 aa, Artificial Sequence
  Description of Artificial Sequence: Synthetic peptide
  Seed: VRHCPHHER (TP53 R175H)
VVHCPHHEL

SEQ ID NO: 19729 - protein, 9 aa, Artificial Sequence
  Description of Artificial Sequence: Synthetic peptide
  Seed: VRHCPHHER (TP53 R175H)
VVHCPHHEM

SEQ ID NO: 19730 - protein, 9 aa, Artificial Sequence
  Description of Artificial Sequence: Synthetic peptide
  Seed: VRHCPHHER (TP53 R175H)
VVHCPHHEY

SEQ ID NO: 19731 - protein, 9 aa, Artificial Sequence
  Description of Artificial Sequence: Synthetic peptide
  Seed: VRHCPHHER (TP53 R175H)
VWHCPHHEF

SEQ ID NO: 19732 - protein, 9 aa, Artificial Sequence
  Description of Artificial Sequence: Synthetic peptide
  Seed: VRHCPHHER (TP53 R175H)
VWHCPHHEI

SEQ ID NO: 19733 - protein, 9 aa, Artificial Sequence
  Description of Artificial Sequence: Synthetic peptide
  Seed: VRHCPHHER (TP53 R175H)
VWHCPHHEK

SEQ ID NO: 19734 - protein, 9 aa, Artificial Sequence
  Description of Artificial Sequence: Synthetic peptide
  Seed: VRHCPHHER (TP53 R175H)
VWHCPHHEL

SEQ ID NO: 19735 - protein, 9 aa, Artificial Sequence
  Description of Artificial Sequence: Synthetic peptide
  Seed: VRHCPHHER (TP53 R175H)
VWHCPHHEM

SEQ ID NO: 19736 - protein, 9 aa, Artificial Sequence
  Description of Artificial Sequence: Synthetic peptide
  Seed: VRHCPHHER (TP53 R175H)
VWHCPHHER

SEQ ID NO: 19737 - protein, 9 aa, Artificial Sequence
  Description of Artificial Sequence: Synthetic peptide
  Seed: VRHCPHHER (TP53 R175H)
VWHCPHHEY

SEQ ID NO: 19738 - protein, 9 aa, Artificial Sequence
  Description of Artificial Sequence: Synthetic peptide
  Seed: VRHCPHHER (TP53 R175H)
VYHCPHHEF

SEQ ID NO: 19739 - protein, 9 aa, Artificial Sequence
  Description of Artificial Sequence: Synthetic peptide
  Seed: VRHCPHHER (TP53 R175H)
VYHCPHHEI

SEQ ID NO: 19740 - protein, 9 aa, Artificial Sequence
  Description of Artificial Sequence: Synthetic peptide
  Seed: VRHCPHHER (TP53 R175H)
VYHCPHHEK

SEQ ID NO: 19741 - protein, 9 aa, Artificial Sequence
  Description of Artificial Sequence: Synthetic peptide
  Seed: VRHCPHHER (TP53 R175H)
VYHCPHHEL

SEQ ID NO: 19742 - protein, 9 aa, Artificial Sequence
  Description of Artificial Sequence: Synthetic peptide
  Seed: VRHCPHHER (TP53 R175H)
VYHCPHHEM

SEQ ID NO: 19743 - protein, 9 aa, Artificial Sequence
  Description of Artificial Sequence: Synthetic peptide
  Seed: VRHCPHHER (TP53 R175H)
VYHCPHHER

SEQ ID NO: 19744 - protein, 9 aa, Artificial Sequence
  Description of Artificial Sequence: Synthetic peptide
  Seed: VRHCPHHER (TP53 R175H)
VYHCPHHEV

SEQ ID NO: 19745 - protein, 9 aa, Artificial Sequence
  Description of Artificial Sequence: Synthetic peptide
  Seed: VRHCPHHER (TP53 R175H)
VYHCPHHEW

SEQ ID NO: 19746 - protein, 9 aa, Artificial Sequence
  Description of Artificial Sequence: Synthetic peptide
  Seed: VRHCPHHER (TP53 R175H)
VYHCPHHEY

SEQ ID NO: 19747 - protein, 9 aa, Homo sapiens
  Native (TP53 R175H)
VRHCPHHER

SEQ ID NO: 19748 - protein, 9 aa, Homo sapiens
  Native (TP53 R175H)
EVVRHCPHH

SEQ ID NO: 19749 - protein, 9 aa, Homo sapiens
  Native (TP53 R175H)
HMTEVVRHC

SEQ ID NO: 19750 - protein, 10 aa, Homo sapiens
  Native (TP53 R175H)
QHMTEVVRHC

SEQ ID NO: 19751 - protein, 8 aa, Homo sapiens
  Native (TP53 R175H)
TEVVRHCP

SEQ ID NO: 19752 - protein, 9 aa, Homo sapiens
  Native (TP53 R175H)
TEVVRHCPH

SEQ ID NO: 19753 - protein, 10 aa, Artificial Sequence
  Description of Artificial Sequence: Synthetic peptide
  Seed: GMNQRPILTI (TP53 R248Q)
GINQRPILTV

SEQ ID NO: 19754 - protein, 10 aa, Artificial Sequence
  Description of Artificial Sequence: Synthetic peptide
  Seed: GMNQRPILTI (TP53 R248Q)
GLNQRPILTA

SEQ ID NO: 19755 - protein, 10 aa, Artificial Sequence
  Description of Artificial Sequence: Synthetic peptide
  Seed: GMNQRPILTI (TP53 R248Q)
GLNQRPILTI

SEQ ID NO: 19756 - protein, 11 aa, Artificial Sequence
  Description of Artificial Sequence: Synthetic peptide
  Seed: GMNQRPILTII (TP53 R248Q)
GLNQRPILTII

SEQ ID NO: 19757 - protein, 11 aa, Artificial Sequence
  Description of Artificial Sequence: Synthetic peptide
  Seed: GMNQRPILTII (TP53 R248Q)
GLNQRPILTIL

SEQ ID NO: 19758 - protein, 11 aa, Artificial Sequence
  Description of Artificial Sequence: Synthetic peptide
  Seed: GMNQRPILTII (TP53 R248Q)
GLNQRPILTIV

SEQ ID NO: 19759 - protein, 10 aa, Artificial Sequence
  Description of Artificial Sequence: Synthetic peptide
  Seed: GMNQRPILTI (TP53 R248Q)
GLNQRPILTL

SEQ ID NO: 19760 - protein, 10 aa, Artificial Sequence
  Description of Artificial Sequence: Synthetic peptide
  Seed: GMNQRPILTI (TP53 R248Q)
GMNQRPILTA

SEQ ID NO: 19761 - protein, 11 aa, Artificial Sequence
  Description of Artificial Sequence: Synthetic peptide
  Seed: GMNQRPILTII (TP53 R248Q)
GMNQRPILTIA

SEQ ID NO: 19762 - protein, 11 aa, Artificial Sequence
  Description of Artificial Sequence: Synthetic peptide
  Seed: GMNQRPILTII (TP53 R248Q)
GMNQRPILTIL

SEQ ID NO: 19763 - protein, 11 aa, Artificial Sequence
  Description of Artificial Sequence: Synthetic peptide
  Seed: GMNQRPILTII (TP53 R248Q)
GMNQRPILTIV

SEQ ID NO: 19764 - protein, 10 aa, Artificial Sequence
  Description of Artificial Sequence: Synthetic peptide
  Seed: GMNQRPILTI (TP53 R248Q)
GMNQRPILTL

SEQ ID NO: 19765 - protein, 10 aa, Artificial Sequence
  Description of Artificial Sequence: Synthetic peptide
  Seed: GMNQRPILTI (TP53 R248Q)
GQNQRPILTV

SEQ ID NO: 19766 - protein, 10 aa, Artificial Sequence
  Description of Artificial Sequence: Synthetic peptide
  Seed: MNQRPILTII (TP53 R248Q)
MAQRPILTIF

SEQ ID NO: 19767 - protein, 10 aa, Artificial Sequence
  Description of Artificial Sequence: Synthetic peptide
  Seed: MNQRPILTII (TP53 R248Q)
MAQRPILTIH

SEQ ID NO: 19768 - protein, 10 aa, Artificial Sequence
  Description of Artificial Sequence: Synthetic peptide
  Seed: MNQRPILTII (TP53 R248Q)
MAQRPILTII

SEQ ID NO: 19769 - protein, 10 aa, Artificial Sequence
  Description of Artificial Sequence: Synthetic peptide
  Seed: MNQRPILTII (TP53 R248Q)
MAQRPILTIL

SEQ ID NO: 19770 - protein, 10 aa, Artificial Sequence
  Description of Artificial Sequence: Synthetic peptide
  Seed: MNQRPILTII (TP53 R248Q)
MAQRPILTIM

SEQ ID NO: 19771 - protein, 10 aa, Artificial Sequence
  Description of Artificial Sequence: Synthetic peptide
  Seed: MNQRPILTII (TP53 R248Q)
MAQRPILTIV

SEQ ID NO: 19772 - protein, 10 aa, Artificial Sequence
  Description of Artificial Sequence: Synthetic peptide
  Seed: MNQRPILTII (TP53 R248Q)
MAQRPILTIW

SEQ ID NO: 19773 - protein, 10 aa, Artificial Sequence
  Description of Artificial Sequence: Synthetic peptide
  Seed: MNQRPILTII (TP53 R248Q)
MAQRPILTIY

SEQ ID NO: 19774 - protein, 10 aa, Artificial Sequence
  Description of Artificial Sequence: Synthetic peptide
  Seed: MNQRPILTII (TP53 R248Q)
MCQRPILTIF

SEQ ID NO: 19775 - protein, 10 aa, Artificial Sequence
  Description of Artificial Sequence: Synthetic peptide
  Seed: MNQRPILTII (TP53 R248Q)
MCQRPILTIH

SEQ ID NO: 19776 - protein, 10 aa, Artificial Sequence
  Description of Artificial Sequence: Synthetic peptide
  Seed: MNQRPILTII (TP53 R248Q)
MCQRPILTII

SEQ ID NO: 19777 - protein, 10 aa, Artificial Sequence
  Description of Artificial Sequence: Synthetic peptide
  Seed: MNQRPILTII (TP53 R248Q)
MCQRPILTIL

SEQ ID NO: 19778 - protein, 10 aa, Artificial Sequence
  Description of Artificial Sequence: Synthetic peptide
  Seed: MNQRPILTII (TP53 R248Q)
MCQRPILTIM

SEQ ID NO: 19779 - protein, 10 aa, Artificial Sequence
  Description of Artificial Sequence: Synthetic peptide
  Seed: MNQRPILTII (TP53 R248Q)
MCQRPILTIV

SEQ ID NO: 19780 - protein, 10 aa, Artificial Sequence
  Description of Artificial Sequence: Synthetic peptide
  Seed: MNQRPILTII (TP53 R248Q)
MCQRPILTIW

SEQ ID NO: 19781 - protein, 10 aa, Artificial Sequence
  Description of Artificial Sequence: Synthetic peptide
  Seed: MNQRPILTII (TP53 R248Q)
MCQRPILTIY

SEQ ID NO: 19782 - protein, 10 aa, Artificial Sequence
  Description of Artificial Sequence: Synthetic peptide
  Seed: MNQRPILTII (TP53 R248Q)
MDQRPILTIF

SEQ ID NO: 19783 - protein, 10 aa, Artificial Sequence
  Description of Artificial Sequence: Synthetic peptide
  Seed: MNQRPILTII (TP53 R248Q)
MDQRPILTIH

SEQ ID NO: 19784 - protein, 10 aa, Artificial Sequence
  Description of Artificial Sequence: Synthetic peptide
  Seed: MNQRPILTII (TP53 R248Q)
MDQRPILTII

SEQ ID NO: 19785 - protein, 10 aa, Artificial Sequence
  Description of Artificial Sequence: Synthetic peptide
  Seed: MNQRPILTII (TP53 R248Q)
MDQRPILTIL

SEQ ID NO: 19786 - protein, 10 aa, Artificial Sequence
  Description of Artificial Sequence: Synthetic peptide
  Seed: MNQRPILTII (TP53 R248Q)
MDQRPILTIM

SEQ ID NO: 19787 - protein, 10 aa, Artificial Sequence
  Description of Artificial Sequence: Synthetic peptide
  Seed: MNQRPILTII (TP53 R248Q)
MDQRPILTIV

SEQ ID NO: 19788 - protein, 10 aa, Artificial Sequence
  Description of Artificial Sequence: Synthetic peptide
  Seed: MNQRPILTII (TP53 R248Q)
MDQRPILTIW

SEQ ID NO: 19789 - protein, 10 aa, Artificial Sequence
  Description of Artificial Sequence: Synthetic peptide
  Seed: MNQRPILTII (TP53 R248Q)
MDQRPILTIY

SEQ ID NO: 19790 - protein, 10 aa, Artificial Sequence
  Description of Artificial Sequence: Synthetic peptide
  Seed: MNQRPILTII (TP53 R248Q)
MEQRPILTIF

SEQ ID NO: 19791 - protein, 10 aa, Artificial Sequence
  Description of Artificial Sequence: Synthetic peptide
  Seed: MNQRPILTII (TP53 R248Q)
MEQRPILTIH

SEQ ID NO: 19792 - protein, 10 aa, Artificial Sequence
  Description of Artificial Sequence: Synthetic peptide
  Seed: MNQRPILTII (TP53 R248Q)
MEQRPILTII

SEQ ID NO: 19793 - protein, 10 aa, Artificial Sequence
  Description of Artificial Sequence: Synthetic peptide
  Seed: MNQRPILTII (TP53 R248Q)
MEQRPILTIL

SEQ ID NO: 19794 - protein, 10 aa, Artificial Sequence
  Description of Artificial Sequence: Synthetic peptide
  Seed: MNQRPILTII (TP53 R248Q)
MEQRPILTIM

SEQ ID NO: 19795 - protein, 10 aa, Artificial Sequence
  Description of Artificial Sequence: Synthetic peptide
  Seed: MNQRPILTII (TP53 R248Q)
MEQRPILTIV

SEQ ID NO: 19796 - protein, 10 aa, Artificial Sequence
  Description of Artificial Sequence: Synthetic peptide
  Seed: MNQRPILTII (TP53 R248Q)
MEQRPILTIW

SEQ ID NO: 19797 - protein, 10 aa, Artificial Sequence
  Description of Artificial Sequence: Synthetic peptide
  Seed: MNQRPILTII (TP53 R248Q)
MEQRPILTIY

SEQ ID NO: 19798 - protein, 10 aa, Artificial Sequence
  Description of Artificial Sequence: Synthetic peptide
  Seed: MNQRPILTII (TP53 R248Q)
MFQRPILTIF

SEQ ID NO: 19799 - protein, 10 aa, Artificial Sequence
  Description of Artificial Sequence: Synthetic peptide
  Seed: MNQRPILTII (TP53 R248Q)
MFQRPILTIH

SEQ ID NO: 19800 - protein, 10 aa, Artificial Sequence
  Description of Artificial Sequence: Synthetic peptide
  Seed: MNQRPILTII (TP53 R248Q)
MFQRPILTII

SEQ ID NO: 19801 - protein, 10 aa, Artificial Sequence
  Description of Artificial Sequence: Synthetic peptide
  Seed: MNQRPILTII (TP53 R248Q)
MFQRPILTIL

SEQ ID NO: 19802 - protein, 10 aa, Artificial Sequence
  Description of Artificial Sequence: Synthetic peptide
  Seed: MNQRPILTII (TP53 R248Q)
MFQRPILTIM

SEQ ID NO: 19803 - protein, 10 aa, Artificial Sequence
  Description of Artificial Sequence: Synthetic peptide
  Seed: MNQRPILTII (TP53 R248Q)
MFQRPILTIV

SEQ ID NO: 19804 - protein, 10 aa, Artificial Sequence
  Description of Artificial Sequence: Synthetic peptide
  Seed: MNQRPILTII (TP53 R248Q)
MFQRPILTIW

SEQ ID NO: 19805 - protein, 10 aa, Artificial Sequence
  Description of Artificial Sequence: Synthetic peptide
  Seed: MNQRPILTII (TP53 R248Q)
MFQRPILTIY

SEQ ID NO: 19806 - protein, 10 aa, Artificial Sequence
  Description of Artificial Sequence: Synthetic peptide
  Seed: MNQRPILTII (TP53 R248Q)
MGQRPILTIF

SEQ ID NO: 19807 - protein, 10 aa, Artificial Sequence
  Description of Artificial Sequence: Synthetic peptide
  Seed: MNQRPILTII (TP53 R248Q)
MGQRPILTIH

SEQ ID NO: 19808 - protein, 10 aa, Artificial Sequence
  Description of Artificial Sequence: Synthetic peptide
  Seed: MNQRPILTII (TP53 R248Q)
MGQRPILTII

SEQ ID NO: 19809 - protein, 10 aa, Artificial Sequence
  Description of Artificial Sequence: Synthetic peptide
  Seed: MNQRPILTII (TP53 R248Q)
MGQRPILTIL

SEQ ID NO: 19810 - protein, 10 aa, Artificial Sequence
  Description of Artificial Sequence: Synthetic peptide
  Seed: MNQRPILTII (TP53 R248Q)
MGQRPILTIM

SEQ ID NO: 19811 - protein, 10 aa, Artificial Sequence
  Description of Artificial Sequence: Synthetic peptide
  Seed: MNQRPILTII (TP53 R248Q)
MGQRPILTIV

SEQ ID NO: 19812 - protein, 10 aa, Artificial Sequence
  Description of Artificial Sequence: Synthetic peptide
  Seed: MNQRPILTII (TP53 R248Q)
MGQRPILTIW

SEQ ID NO: 19813 - protein, 10 aa, Artificial Sequence
  Description of Artificial Sequence: Synthetic peptide
  Seed: MNQRPILTII (TP53 R248Q)
MGQRPILTIY

SEQ ID NO: 19814 - protein, 10 aa, Artificial Sequence
  Description of Artificial Sequence: Synthetic peptide
  Seed: MNQRPILTII (TP53 R248Q)
MHQRPILTIF

SEQ ID NO: 19815 - protein, 10 aa, Artificial Sequence
  Description of Artificial Sequence: Synthetic peptide
  Seed: MNQRPILTII (TP53 R248Q)
MHQRPILTIH

SEQ ID NO: 19816 - protein, 10 aa, Artificial Sequence
  Description of Artificial Sequence: Synthetic peptide
  Seed: MNQRPILTII (TP53 R248Q)
MHQRPILTII

SEQ ID NO: 19817 - protein, 10 aa, Artificial Sequence
  Description of Artificial Sequence: Synthetic peptide
  Seed: MNQRPILTII (TP53 R248Q)
MHQRPILTIL

SEQ ID NO: 19818 - protein, 10 aa, Artificial Sequence
  Description of Artificial Sequence: Synthetic peptide
  Seed: MNQRPILTII (TP53 R248Q)
MHQRPILTIM

SEQ ID NO: 19819 - protein, 10 aa, Artificial Sequence
  Description of Artificial Sequence: Synthetic peptide
  Seed: MNQRPILTII (TP53 R248Q)
MHQRPILTIV

SEQ ID NO: 19820 - protein, 10 aa, Artificial Sequence
  Description of Artificial Sequence: Synthetic peptide
  Seed: MNQRPILTII (TP53 R248Q)
MHQRPILTIW

SEQ ID NO: 19821 - protein, 10 aa, Artificial Sequence
  Description of Artificial Sequence: Synthetic peptide
  Seed: MNQRPILTII (TP53 R248Q)
MHQRPILTIY

SEQ ID NO: 19822 - protein, 10 aa, Artificial Sequence
  Description of Artificial Sequence: Synthetic peptide
  Seed: MNQRPILTII (TP53 R248Q)
MIQRPILTIA

SEQ ID NO: 19823 - protein, 10 aa, Artificial Sequence
  Description of Artificial Sequence: Synthetic peptide
  Seed: MNQRPILTII (TP53 R248Q)
MIQRPILTIF

SEQ ID NO: 19824 - protein, 10 aa, Artificial Sequence
  Description of Artificial Sequence: Synthetic peptide
  Seed: MNQRPILTII (TP53 R248Q)
MIQRPILTIH

SEQ ID NO: 19825 - protein, 10 aa, Artificial Sequence
  Description of Artificial Sequence: Synthetic peptide
  Seed: MNQRPILTII (TP53 R248Q)
MIQRPILTII

SEQ ID NO: 19826 - protein, 10 aa, Artificial Sequence
  Description of Artificial Sequence: Synthetic peptide
  Seed: MNQRPILTII (TP53 R248Q)
MIQRPILTIL

SEQ ID NO: 19827 - protein, 10 aa, Artificial Sequence
  Description of Artificial Sequence: Synthetic peptide
  Seed: MNQRPILTII (TP53 R248Q)
MIQRPILTIM

SEQ ID NO: 19828 - protein, 10 aa, Artificial Sequence
  Description of Artificial Sequence: Synthetic peptide
  Seed: MNQRPILTII (TP53 R248Q)
MIQRPILTIV

SEQ ID NO: 19829 - protein, 10 aa, Artificial Sequence
  Description of Artificial Sequence: Synthetic peptide
  Seed: MNQRPILTII (TP53 R248Q)
MIQRPILTIW

SEQ ID NO: 19830 - protein, 10 aa, Artificial Sequence
  Description of Artificial Sequence: Synthetic peptide
  Seed: MNQRPILTII (TP53 R248Q)
MIQRPILTIY

SEQ ID NO: 19831 - protein, 10 aa, Artificial Sequence
  Description of Artificial Sequence: Synthetic peptide
  Seed: MNQRPILTII (TP53 R248Q)
MKQRPILTIF

SEQ ID NO: 19832 - protein, 10 aa, Artificial Sequence
  Description of Artificial Sequence: Synthetic peptide
  Seed: MNQRPILTII (TP53 R248Q)
MKQRPILTIH

SEQ ID NO: 19833 - protein, 10 aa, Artificial Sequence
  Description of Artificial Sequence: Synthetic peptide
  Seed: MNQRPILTII (TP53 R248Q)
MKQRPILTII

SEQ ID NO: 19834 - protein, 10 aa, Artificial Sequence
  Description of Artificial Sequence: Synthetic peptide
  Seed: MNQRPILTII (TP53 R248Q)
MKQRPILTIL

SEQ ID NO: 19835 - protein, 10 aa, Artificial Sequence
  Description of Artificial Sequence: Synthetic peptide
  Seed: MNQRPILTII (TP53 R248Q)
MKQRPILTIM

SEQ ID NO: 19836 - protein, 10 aa, Artificial Sequence
  Description of Artificial Sequence: Synthetic peptide
  Seed: MNQRPILTII (TP53 R248Q)
MKQRPILTIV

SEQ ID NO: 19837 - protein, 10 aa, Artificial Sequence
  Description of Artificial Sequence: Synthetic peptide
  Seed: MNQRPILTII (TP53 R248Q)
MKQRPILTIW

SEQ ID NO: 19838 - protein, 10 aa, Artificial Sequence
  Description of Artificial Sequence: Synthetic peptide
  Seed: MNQRPILTII (TP53 R248Q)
MKQRPILTIY

SEQ ID NO: 19839 - protein, 10 aa, Artificial Sequence
  Description of Artificial Sequence: Synthetic peptide
  Seed: MNQRPILTII (TP53 R248Q)
MLQRPILTIA

SEQ ID NO: 19840 - protein, 10 aa, Artificial Sequence
  Description of Artificial Sequence: Synthetic peptide
  Seed: MNQRPILTII (TP53 R248Q)
MLQRPILTIF

SEQ ID NO: 19841 - protein, 10 aa, Artificial Sequence
  Description of Artificial Sequence: Synthetic peptide
  Seed: MNQRPILTII (TP53 R248Q)
MLQRPILTIH

SEQ ID NO: 19842 - protein, 10 aa, Artificial Sequence
  Description of Artificial Sequence: Synthetic peptide
  Seed: MNQRPILTII (TP53 R248Q)
MLQRPILTII

SEQ ID NO: 19843 - protein, 10 aa, Artificial Sequence
  Description of Artificial Sequence: Synthetic peptide
  Seed: MNQRPILTII (TP53 R248Q)
MLQRPILTIL

SEQ ID NO: 19844 - protein, 10 aa, Artificial Sequence
  Description of Artificial Sequence: Synthetic peptide
  Seed: MNQRPILTII (TP53 R248Q)
MLQRPILTIM

SEQ ID NO: 19845 - protein, 10 aa, Artificial Sequence
  Description of Artificial Sequence: Synthetic peptide
  Seed: MNQRPILTII (TP53 R248Q)
MLQRPILTIS

SEQ ID NO: 19846 - protein, 10 aa, Artificial Sequence
  Description of Artificial Sequence: Synthetic peptide
  Seed: MNQRPILTII (TP53 R248Q)
MLQRPILTIT

SEQ ID NO: 19847 - protein, 10 aa, Artificial Sequence
  Description of Artificial Sequence: Synthetic peptide
  Seed: MNQRPILTII (TP53 R248Q)
MLQRPILTIV

SEQ ID NO: 19848 - protein, 10 aa, Artificial Sequence
  Description of Artificial Sequence: Synthetic peptide
  Seed: MNQRPILTII (TP53 R248Q)
MLQRPILTIW

SEQ ID NO: 19849 - protein, 10 aa, Artificial Sequence
  Description of Artificial Sequence: Synthetic peptide
  Seed: MNQRPILTII (TP53 R248Q)
MMQRPILTIA

SEQ ID NO: 19850 - protein, 10 aa, Artificial Sequence
  Description of Artificial Sequence: Synthetic peptide
  Seed: MNQRPILTII (TP53 R248Q)
MMQRPILTIC

SEQ ID NO: 19851 - protein, 10 aa, Artificial Sequence
  Description of Artificial Sequence: Synthetic peptide
  Seed: MNQRPILTII (TP53 R248Q)
MMQRPILTIF

SEQ ID NO: 19852 - protein, 10 aa, Artificial Sequence
  Description of Artificial Sequence: Synthetic peptide
  Seed: MNQRPILTII (TP53 R248Q)
MMQRPILTIH

SEQ ID NO: 19853 - protein, 10 aa, Artificial Sequence
  Description of Artificial Sequence: Synthetic peptide
  Seed: MNQRPILTII (TP53 R248Q)
MMQRPILTII

SEQ ID NO: 19854 - protein, 10 aa, Artificial Sequence
  Description of Artificial Sequence: Synthetic peptide
  Seed: MNQRPILTII (TP53 R248Q)
MMQRPILTIL

SEQ ID NO: 19855 - protein, 10 aa, Artificial Sequence
  Description of Artificial Sequence: Synthetic peptide
  Seed: MNQRPILTII (TP53 R248Q)
MMQRPILTIP

SEQ ID NO: 19856 - protein, 10 aa, Artificial Sequence
  Description of Artificial Sequence: Synthetic peptide
  Seed: MNQRPILTII (TP53 R248Q)
MMQRPILTIS

SEQ ID NO: 19857 - protein, 10 aa, Artificial Sequence
  Description of Artificial Sequence: Synthetic peptide
  Seed: MNQRPILTII (TP53 R248Q)
MMQRPILTIT

SEQ ID NO: 19858 - protein, 10 aa, Artificial Sequence
  Description of Artificial Sequence: Synthetic peptide
  Seed: MNQRPILTII (TP53 R248Q)
MMQRPILTIV

SEQ ID NO: 19859 - protein, 10 aa, Artificial Sequence
  Description of Artificial Sequence: Synthetic peptide
  Seed: MNQRPILTII (TP53 R248Q)
MMQRPILTIW

SEQ ID NO: 19860 - protein, 10 aa, Artificial Sequence
  Description of Artificial Sequence: Synthetic peptide
  Seed: MNQRPILTII (TP53 R248Q)
MMQRPILTIY

SEQ ID NO: 19861 - protein, 10 aa, Artificial Sequence
  Description of Artificial Sequence: Synthetic peptide
  Seed: MNQRPILTII (TP53 R248Q)
MNQRPILTIF

SEQ ID NO: 19862 - protein, 10 aa, Artificial Sequence
  Description of Artificial Sequence: Synthetic peptide
  Seed: MNQRPILTII (TP53 R248Q)
MNQRPILTIH

SEQ ID NO: 19863 - protein, 10 aa, Artificial Sequence
  Description of Artificial Sequence: Synthetic peptide
  Seed: MNQRPILTII (TP53 R248Q)
MNQRPILTIL

SEQ ID NO: 19864 - protein, 10 aa, Artificial Sequence
  Description of Artificial Sequence: Synthetic peptide
  Seed: MNQRPILTII (TP53 R248Q)
MNQRPILTIM

SEQ ID NO: 19865 - protein, 10 aa, Artificial Sequence
  Description of Artificial Sequence: Synthetic peptide
  Seed: MNQRPILTII (TP53 R248Q)
MNQRPILTIV

SEQ ID NO: 19866 - protein, 10 aa, Artificial Sequence
  Description of Artificial Sequence: Synthetic peptide
  Seed: MNQRPILTII (TP53 R248Q)
MNQRPILTIW

SEQ ID NO: 19867 - protein, 10 aa, Artificial Sequence
  Description of Artificial Sequence: Synthetic peptide
  Seed: MNQRPILTII (TP53 R248Q)
MNQRPILTIY

SEQ ID NO: 19868 - protein, 10 aa, Artificial Sequence
  Description of Artificial Sequence: Synthetic peptide
  Seed: MNQRPILTII (TP53 R248Q)
MPQRPILTIF

SEQ ID NO: 19869 - protein, 10 aa, Artificial Sequence
  Description of Artificial Sequence: Synthetic peptide
  Seed: MNQRPILTII (TP53 R248Q)
MPQRPILTIH

SEQ ID NO: 19870 - protein, 10 aa, Artificial Sequence
  Description of Artificial Sequence: Synthetic peptide
  Seed: MNQRPILTII (TP53 R248Q)
MPQRPILTII

SEQ ID NO: 19871 - protein, 10 aa, Artificial Sequence
  Description of Artificial Sequence: Synthetic peptide
  Seed: MNQRPILTII (TP53 R248Q)
MPQRPILTIL

SEQ ID NO: 19872 - protein, 10 aa, Artificial Sequence
  Description of Artificial Sequence: Synthetic peptide
  Seed: MNQRPILTII (TP53 R248Q)
MPQRPILTIM

SEQ ID NO: 19873 - protein, 10 aa, Artificial Sequence
  Description of Artificial Sequence: Synthetic peptide
  Seed: MNQRPILTII (TP53 R248Q)
MPQRPILTIV

SEQ ID NO: 19874 - protein, 10 aa, Artificial Sequence
  Description of Artificial Sequence: Synthetic peptide
  Seed: MNQRPILTII (TP53 R248Q)
MPQRPILTIW

SEQ ID NO: 19875 - protein, 10 aa, Artificial Sequence
  Description of Artificial Sequence: Synthetic peptide
  Seed: MNQRPILTII (TP53 R248Q)
MPQRPILTIY

SEQ ID NO: 19876 - protein, 10 aa, Artificial Sequence
  Description of Artificial Sequence: Synthetic peptide
  Seed: MNQRPILTII (TP53 R248Q)
MQQRPILTIA

SEQ ID NO: 19877 - protein, 10 aa, Artificial Sequence
  Description of Artificial Sequence: Synthetic peptide
  Seed: MNQRPILTII (TP53 R248Q)
MQQRPILTIF

SEQ ID NO: 19878 - protein, 10 aa, Artificial Sequence
  Description of Artificial Sequence: Synthetic peptide
  Seed: MNQRPILTII (TP53 R248Q)
MQQRPILTIH

SEQ ID NO: 19879 - protein, 10 aa, Artificial Sequence
  Description of Artificial Sequence: Synthetic peptide
  Seed: MNQRPILTII (TP53 R248Q)
MQQRPILTII

SEQ ID NO: 19880 - protein, 10 aa, Artificial Sequence
  Description of Artificial Sequence: Synthetic peptide
  Seed: MNQRPILTII (TP53 R248Q)
MQQRPILTIL

SEQ ID NO: 19881 - protein, 10 aa, Artificial Sequence
  Description of Artificial Sequence: Synthetic peptide
  Seed: MNQRPILTII (TP53 R248Q)
MQQRPILTIM

SEQ ID NO: 19882 - protein, 10 aa, Artificial Sequence
  Description of Artificial Sequence: Synthetic peptide
  Seed: MNQRPILTII (TP53 R248Q)
MQQRPILTIV

SEQ ID NO: 19883 - protein, 10 aa, Artificial Sequence
  Description of Artificial Sequence: Synthetic peptide
  Seed: MNQRPILTII (TP53 R248Q)
MQQRPILTIW

SEQ ID NO: 19884 - protein, 10 aa, Artificial Sequence
  Description of Artificial Sequence: Synthetic peptide
  Seed: MNQRPILTII (TP53 R248Q)
MQQRPILTIY

SEQ ID NO: 19885 - protein, 10 aa, Artificial Sequence
  Description of Artificial Sequence: Synthetic peptide
  Seed: MNQRPILTII (TP53 R248Q)
MRQRPILTIF

SEQ ID NO: 19886 - protein, 10 aa, Artificial Sequence
  Description of Artificial Sequence: Synthetic peptide
  Seed: MNQRPILTII (TP53 R248Q)
MRQRPILTIH

SEQ ID NO: 19887 - protein, 10 aa, Artificial Sequence
  Description of Artificial Sequence: Synthetic peptide
  Seed: MNQRPILTII (TP53 R248Q)
MRQRPILTII

SEQ ID NO: 19888 - protein, 10 aa, Artificial Sequence
  Description of Artificial Sequence: Synthetic peptide
  Seed: MNQRPILTII (TP53 R248Q)
MRQRPILTIL

SEQ ID NO: 19889 - protein, 10 aa, Artificial Sequence
  Description of Artificial Sequence: Synthetic peptide
  Seed: MNQRPILTII (TP53 R248Q)
MRQRPILTIM

SEQ ID NO: 19890 - protein, 10 aa, Artificial Sequence
  Description of Artificial Sequence: Synthetic peptide
  Seed: MNQRPILTII (TP53 R248Q)
MRQRPILTIV

SEQ ID NO: 19891 - protein, 10 aa, Artificial Sequence
  Description of Artificial Sequence: Synthetic peptide
  Seed: MNQRPILTII (TP53 R248Q)
MRQRPILTIW

SEQ ID NO: 19892 - protein, 10 aa, Artificial Sequence
  Description of Artificial Sequence: Synthetic peptide
  Seed: MNQRPILTII (TP53 R248Q)
MRQRPILTIY

SEQ ID NO: 19893 - protein, 10 aa, Artificial Sequence
  Description of Artificial Sequence: Synthetic peptide
  Seed: MNQRPILTII (TP53 R248Q)
MSQRPILTIA

SEQ ID NO: 19894 - protein, 10 aa, Artificial Sequence
  Description of Artificial Sequence: Synthetic peptide
  Seed: MNQRPILTII (TP53 R248Q)
MSQRPILTIF

SEQ ID NO: 19895 - protein, 10 aa, Artificial Sequence
  Description of Artificial Sequence: Synthetic peptide
  Seed: MNQRPILTII (TP53 R248Q)
MSQRPILTIH

SEQ ID NO: 19896 - protein, 10 aa, Artificial Sequence
  Description of Artificial Sequence: Synthetic peptide
  Seed: MNQRPILTII (TP53 R248Q)
MSQRPILTII

SEQ ID NO: 19897 - protein, 10 aa, Artificial Sequence
  Description of Artificial Sequence: Synthetic peptide
  Seed: MNQRPILTII (TP53 R248Q)
MSQRPILTIL

SEQ ID NO: 19898 - protein, 10 aa, Artificial Sequence
  Description of Artificial Sequence: Synthetic peptide
  Seed: MNQRPILTII (TP53 R248Q)
MSQRPILTIM

SEQ ID NO: 19899 - protein, 10 aa, Artificial Sequence
  Description of Artificial Sequence: Synthetic peptide
  Seed: MNQRPILTII (TP53 R248Q)
MSQRPILTIV

SEQ ID NO: 19900 - protein, 10 aa, Artificial Sequence
  Description of Artificial Sequence: Synthetic peptide
  Seed: MNQRPILTII (TP53 R248Q)
MSQRPILTIW

SEQ ID NO: 19901 - protein, 10 aa, Artificial Sequence
  Description of Artificial Sequence: Synthetic peptide
  Seed: MNQRPILTII (TP53 R248Q)
MSQRPILTIY

SEQ ID NO: 19902 - protein, 10 aa, Artificial Sequence
  Description of Artificial Sequence: Synthetic peptide
  Seed: MNQRPILTII (TP53 R248Q)
MTQRPILTIA

SEQ ID NO: 19903 - protein, 10 aa, Artificial Sequence
  Description of Artificial Sequence: Synthetic peptide
  Seed: MNQRPILTII (TP53 R248Q)
MTQRPILTIF

SEQ ID NO: 19904 - protein, 10 aa, Artificial Sequence
  Description of Artificial Sequence: Synthetic peptide
  Seed: MNQRPILTII (TP53 R248Q)
MTQRPILTIH

SEQ ID NO: 19905 - protein, 10 aa, Artificial Sequence
  Description of Artificial Sequence: Synthetic peptide
  Seed: MNQRPILTII (TP53 R248Q)
MTQRPILTII

SEQ ID NO: 19906 - protein, 10 aa, Artificial Sequence
  Description of Artificial Sequence: Synthetic peptide
  Seed: MNQRPILTII (TP53 R248Q)
MTQRPILTIL

SEQ ID NO: 19907 - protein, 10 aa, Artificial Sequence
  Description of Artificial Sequence: Synthetic peptide
  Seed: MNQRPILTII (TP53 R248Q)
MTQRPILTIM

SEQ ID NO: 19908 - protein, 10 aa, Artificial Sequence
  Description of Artificial Sequence: Synthetic peptide
  Seed: MNQRPILTII (TP53 R248Q)
MTQRPILTIV

SEQ ID NO: 19909 - protein, 10 aa, Artificial Sequence
  Description of Artificial Sequence: Synthetic peptide
  Seed: MNQRPILTII (TP53 R248Q)
MTQRPILTIW

SEQ ID NO: 19910 - protein, 10 aa, Artificial Sequence
  Description of Artificial Sequence: Synthetic peptide
  Seed: MNQRPILTII (TP53 R248Q)
MTQRPILTIY

SEQ ID NO: 19911 - protein, 10 aa, Artificial Sequence
  Description of Artificial Sequence: Synthetic peptide
  Seed: MNQRPILTII (TP53 R248Q)
MVQRPILTIA

SEQ ID NO: 19912 - protein, 10 aa, Artificial Sequence
  Description of Artificial Sequence: Synthetic peptide
  Seed: MNQRPILTII (TP53 R248Q)
MVQRPILTIF

SEQ ID NO: 19913 - protein, 10 aa, Artificial Sequence
  Description of Artificial Sequence: Synthetic peptide
  Seed: MNQRPILTII (TP53 R248Q)
MVQRPILTIH

SEQ ID NO: 19914 - protein, 10 aa, Artificial Sequence
  Description of Artificial Sequence: Synthetic peptide
  Seed: MNQRPILTII (TP53 R248Q)
MVQRPILTII

SEQ ID NO: 19915 - protein, 10 aa, Artificial Sequence
  Description of Artificial Sequence: Synthetic peptide
  Seed: MNQRPILTII (TP53 R248Q)
MVQRPILTIL

SEQ ID NO: 19916 - protein, 10 aa, Artificial Sequence
  Description of Artificial Sequence: Synthetic peptide
  Seed: MNQRPILTII (TP53 R248Q)
MVQRPILTIM

SEQ ID NO: 19917 - protein, 10 aa, Artificial Sequence
  Description of Artificial Sequence: Synthetic peptide
  Seed: MNQRPILTII (TP53 R248Q)
MVQRPILTIV

SEQ ID NO: 19918 - protein, 10 aa, Artificial Sequence
  Description of Artificial Sequence: Synthetic peptide
  Seed: MNQRPILTII (TP53 R248Q)
MVQRPILTIW

SEQ ID NO: 19919 - protein, 10 aa, Artificial Sequence
  Description of Artificial Sequence: Synthetic peptide
  Seed: MNQRPILTII (TP53 R248Q)
MVQRPILTIY

SEQ ID NO: 19920 - protein, 10 aa, Artificial Sequence
  Description of Artificial Sequence: Synthetic peptide
  Seed: MNQRPILTII (TP53 R248Q)
MWQRPILTIF

SEQ ID NO: 19921 - protein, 10 aa, Artificial Sequence
  Description of Artificial Sequence: Synthetic peptide
  Seed: MNQRPILTII (TP53 R248Q)
MWQRPILTIH

SEQ ID NO: 19922 - protein, 10 aa, Artificial Sequence
  Description of Artificial Sequence: Synthetic peptide
  Seed: MNQRPILTII (TP53 R248Q)
MWQRPILTII

SEQ ID NO: 19923 - protein, 10 aa, Artificial Sequence
  Description of Artificial Sequence: Synthetic peptide
  Seed: MNQRPILTII (TP53 R248Q)
MWQRPILTIL

SEQ ID NO: 19924 - protein, 10 aa, Artificial Sequence
  Description of Artificial Sequence: Synthetic peptide
  Seed: MNQRPILTII (TP53 R248Q)
MWQRPILTIM

SEQ ID NO: 19925 - protein, 10 aa, Artificial Sequence
  Description of Artificial Sequence: Synthetic peptide
  Seed: MNQRPILTII (TP53 R248Q)
MWQRPILTIV

SEQ ID NO: 19926 - protein, 10 aa, Artificial Sequence
  Description of Artificial Sequence: Synthetic peptide
  Seed: MNQRPILTII (TP53 R248Q)
MWQRPILTIW

SEQ ID NO: 19927 - protein, 10 aa, Artificial Sequence
  Description of Artificial Sequence: Synthetic peptide
  Seed: MNQRPILTII (TP53 R248Q)
MWQRPILTIY

SEQ ID NO: 19928 - protein, 10 aa, Artificial Sequence
  Description of Artificial Sequence: Synthetic peptide
  Seed: MNQRPILTII (TP53 R248Q)
MYQRPILTIF

SEQ ID NO: 19929 - protein, 10 aa, Artificial Sequence
  Description of Artificial Sequence: Synthetic peptide
  Seed: MNQRPILTII (TP53 R248Q)
MYQRPILTIH

SEQ ID NO: 19930 - protein, 10 aa, Artificial Sequence
  Description of Artificial Sequence: Synthetic peptide
  Seed: MNQRPILTII (TP53 R248Q)
MYQRPILTII

SEQ ID NO: 19931 - protein, 10 aa, Artificial Sequence
  Description of Artificial Sequence: Synthetic peptide
  Seed: MNQRPILTII (TP53 R248Q)
MYQRPILTIL

SEQ ID NO: 19932 - protein, 10 aa, Artificial Sequence
  Description of Artificial Sequence: Synthetic peptide
  Seed: MNQRPILTII (TP53 R248Q)
MYQRPILTIM

SEQ ID NO: 19933 - protein, 10 aa, Artificial Sequence
  Description of Artificial Sequence: Synthetic peptide
  Seed: MNQRPILTII (TP53 R248Q)
MYQRPILTIV

SEQ ID NO: 19934 - protein, 10 aa, Artificial Sequence
  Description of Artificial Sequence: Synthetic peptide
  Seed: MNQRPILTII (TP53 R248Q)
MYQRPILTIW

SEQ ID NO: 19935 - protein, 10 aa, Artificial Sequence
  Description of Artificial Sequence: Synthetic peptide
  Seed: MNQRPILTII (TP53 R248Q)
MYQRPILTIY

SEQ ID NO: 19936 - protein, 11 aa, Artificial Sequence
  Description of Artificial Sequence: Synthetic peptide
  Seed: NSSCMGGMNQR (TP53 R248Q)
NASCMGGMNQK

SEQ ID NO: 19937 - protein, 11 aa, Artificial Sequence
  Description of Artificial Sequence: Synthetic peptide
  Seed: NSSCMGGMNQR (TP53 R248Q)
NASCMGGMNQR

SEQ ID NO: 19938 - protein, 11 aa, Artificial Sequence
  Description of Artificial Sequence: Synthetic peptide
  Seed: NSSCMGGMNQR (TP53 R248Q)
NESCMGGMNQR

SEQ ID NO: 19939 - protein, 11 aa, Artificial Sequence
  Description of Artificial Sequence: Synthetic peptide
  Seed: NSSCMGGMNQR (TP53 R248Q)
NFSCMGGMNQR

SEQ ID NO: 19940 - protein, 11 aa, Artificial Sequence
  Description of Artificial Sequence: Synthetic peptide
  Seed: NSSCMGGMNQR (TP53 R248Q)
NISCMGGMNQR

SEQ ID NO: 19941 - protein, 11 aa, Artificial Sequence
  Description of Artificial Sequence: Synthetic peptide
  Seed: NSSCMGGMNQR (TP53 R248Q)
NKSCMGGMNQR

SEQ ID NO: 19942 - protein, 11 aa, Artificial Sequence
  Description of Artificial Sequence: Synthetic peptide
  Seed: NSSCMGGMNQR (TP53 R248Q)
NMSCMGGMNQR

SEQ ID NO: 19943 - protein, 11 aa, Artificial Sequence
  Description of Artificial Sequence: Synthetic peptide
  Seed: NSSCMGGMNQR (TP53 R248Q)
NRSCMGGMNQR

SEQ ID NO: 19944 - protein, 11 aa, Artificial Sequence
  Description of Artificial Sequence: Synthetic peptide
  Seed: NSSCMGGMNQR (TP53 R248Q)
NSSCMGGMNQK

SEQ ID NO: 19945 - protein, 11 aa, Artificial Sequence
  Description of Artificial Sequence: Synthetic peptide
  Seed: NSSCMGGMNQR (TP53 R248Q)
NTSCMGGMNQK

SEQ ID NO: 19946 - protein, 11 aa, Artificial Sequence
  Description of Artificial Sequence: Synthetic peptide
  Seed: NSSCMGGMNQR (TP53 R248Q)
NTSCMGGMNQR

SEQ ID NO: 19947 - protein, 11 aa, Artificial Sequence
  Description of Artificial Sequence: Synthetic peptide
  Seed: NSSCMGGMNQR (TP53 R248Q)
NVSCMGGMNQK

SEQ ID NO: 19948 - protein, 11 aa, Artificial Sequence
  Description of Artificial Sequence: Synthetic peptide
  Seed: NSSCMGGMNQR (TP53 R248Q)
NVSCMGGMNQR

SEQ ID NO: 19949 - protein, 11 aa, Artificial Sequence
  Description of Artificial Sequence: Synthetic peptide
  Seed: NSSCMGGMNQR (TP53 R248Q)
NYSCMGGMNQR

SEQ ID NO: 19950 - protein, 10 aa, Artificial Sequence
  Description of Artificial Sequence: Synthetic peptide
  Seed: QRPILTIITL (TP53 R248Q)
QAPILTIITF

SEQ ID NO: 19951 - protein, 10 aa, Artificial Sequence
  Description of Artificial Sequence: Synthetic peptide
  Seed: QRPILTIITL (TP53 R248Q)
QAPILTIITL

SEQ ID NO: 19952 - protein, 10 aa, Artificial Sequence
  Description of Artificial Sequence: Synthetic peptide
  Seed: QRPILTIITL (TP53 R248Q)
QAPILTIITM

SEQ ID NO: 19953 - protein, 10 aa, Artificial Sequence
  Description of Artificial Sequence: Synthetic peptide
  Seed: QRPILTIITL (TP53 R248Q)
QCPILTIITF

SEQ ID NO: 19954 - protein, 10 aa, Artificial Sequence
  Description of Artificial Sequence: Synthetic peptide
  Seed: QRPILTIITL (TP53 R248Q)
QCPILTIITL

SEQ ID NO: 19955 - protein, 10 aa, Artificial Sequence
  Description of Artificial Sequence: Synthetic peptide
  Seed: QRPILTIITL (TP53 R248Q)
QCPILTIITM

SEQ ID NO: 19956 - protein, 10 aa, Artificial Sequence
  Description of Artificial Sequence: Synthetic peptide
  Seed: QRPILTIITL (TP53 R248Q)
QDPILTIITF

SEQ ID NO: 19957 - protein, 10 aa, Artificial Sequence
  Description of Artificial Sequence: Synthetic peptide
  Seed: QRPILTIITL (TP53 R248Q)
QDPILTIITL

SEQ ID NO: 19958 - protein, 10 aa, Artificial Sequence
  Description of Artificial Sequence: Synthetic peptide
  Seed: QRPILTIITL (TP53 R248Q)
QDPILTIITM

SEQ ID NO: 19959 - protein, 10 aa, Artificial Sequence
  Description of Artificial Sequence: Synthetic peptide
  Seed: QRPILTIITL (TP53 R248Q)
QEPILTIITF

SEQ ID NO: 19960 - protein, 10 aa, Artificial Sequence
  Description of Artificial Sequence: Synthetic peptide
  Seed: QRPILTIITL (TP53 R248Q)
QEPILTIITL

SEQ ID NO: 19961 - protein, 10 aa, Artificial Sequence
  Description of Artificial Sequence: Synthetic peptide
  Seed: QRPILTIITL (TP53 R248Q)
QEPILTIITM

SEQ ID NO: 19962 - protein, 10 aa, Artificial Sequence
  Description of Artificial Sequence: Synthetic peptide
  Seed: QRPILTIITL (TP53 R248Q)
QFPILTIITA

SEQ ID NO: 19963 - protein, 10 aa, Artificial Sequence
  Description of Artificial Sequence: Synthetic peptide
  Seed: QRPILTIITL (TP53 R248Q)
QFPILTIITF

SEQ ID NO: 19964 - protein, 10 aa, Artificial Sequence
  Description of Artificial Sequence: Synthetic peptide
  Seed: QRPILTIITL (TP53 R248Q)
QFPILTIITI

SEQ ID NO: 19965 - protein, 10 aa, Artificial Sequence
  Description of Artificial Sequence: Synthetic peptide
  Seed: QRPILTIITL (TP53 R248Q)
QFPILTIITL

SEQ ID NO: 19966 - protein, 10 aa, Artificial Sequence
  Description of Artificial Sequence: Synthetic peptide
  Seed: QRPILTIITL (TP53 R248Q)
QFPILTIITM

SEQ ID NO: 19967 - protein, 10 aa, Artificial Sequence
  Description of Artificial Sequence: Synthetic peptide
  Seed: QRPILTIITL (TP53 R248Q)
QFPILTIITV

SEQ ID NO: 19968 - protein, 10 aa, Artificial Sequence
  Description of Artificial Sequence: Synthetic peptide
  Seed: QRPILTIITL (TP53 R248Q)
QGPILTIITF

SEQ ID NO: 19969 - protein, 10 aa, Artificial Sequence
  Description of Artificial Sequence: Synthetic peptide
  Seed: QRPILTIITL (TP53 R248Q)
QGPILTIITL

SEQ ID NO: 19970 - protein, 10 aa, Artificial Sequence
  Description of Artificial Sequence: Synthetic peptide
  Seed: QRPILTIITL (TP53 R248Q)
QGPILTIITM

SEQ ID NO: 19971 - protein, 10 aa, Artificial Sequence
  Description of Artificial Sequence: Synthetic peptide
  Seed: QRPILTIITL (TP53 R248Q)
QHPILTIITF

SEQ ID NO: 19972 - protein, 10 aa, Artificial Sequence
  Description of Artificial Sequence: Synthetic peptide
  Seed: QRPILTIITL (TP53 R248Q)
QHPILTIITI

SEQ ID NO: 19973 - protein, 10 aa, Artificial Sequence
  Description of Artificial Sequence: Synthetic peptide
  Seed: QRPILTIITL (TP53 R248Q)
QHPILTIITL

SEQ ID NO: 19974 - protein, 10 aa, Artificial Sequence
  Description of Artificial Sequence: Synthetic peptide
  Seed: QRPILTIITL (TP53 R248Q)
QHPILTIITM

SEQ ID NO: 19975 - protein, 10 aa, Artificial Sequence
  Description of Artificial Sequence: Synthetic peptide
  Seed: QRPILTIITL (TP53 R248Q)
QHPILTIITV

SEQ ID NO: 19976 - protein, 10 aa, Artificial Sequence
  Description of Artificial Sequence: Synthetic peptide
  Seed: QRPILTIITL (TP53 R248Q)
QIPILTIITF

SEQ ID NO: 19977 - protein, 10 aa, Artificial Sequence
  Description of Artificial Sequence: Synthetic peptide
  Seed: QRPILTIITL (TP53 R248Q)
QIPILTIITL

SEQ ID NO: 19978 - protein, 10 aa, Artificial Sequence
  Description of Artificial Sequence: Synthetic peptide
  Seed: QRPILTIITL (TP53 R248Q)
QIPILTIITM

SEQ ID NO: 19979 - protein, 10 aa, Artificial Sequence
  Description of Artificial Sequence: Synthetic peptide
  Seed: QRPILTIITL (TP53 R248Q)
QIPILTIITV

SEQ ID NO: 19980 - protein, 10 aa, Artificial Sequence
  Description of Artificial Sequence: Synthetic peptide
  Seed: QRPILTIITL (TP53 R248Q)
QKPILTIITF

SEQ ID NO: 19981 - protein, 10 aa, Artificial Sequence
  Description of Artificial Sequence: Synthetic peptide
  Seed: QRPILTIITL (TP53 R248Q)
QKPILTIITL

SEQ ID NO: 19982 - protein, 10 aa, Artificial Sequence
  Description of Artificial Sequence: Synthetic peptide
  Seed: QRPILTIITL (TP53 R248Q)
QKPILTIITM

SEQ ID NO: 19983 - protein, 10 aa, Artificial Sequence
  Description of Artificial Sequence: Synthetic peptide
  Seed: QRPILTIITL (TP53 R248Q)
QLPILTIITF

SEQ ID NO: 19984 - protein, 10 aa, Artificial Sequence
  Description of Artificial Sequence: Synthetic peptide
  Seed: QRPILTIITL (TP53 R248Q)
QLPILTIITL

SEQ ID NO: 19985 - protein, 10 aa, Artificial Sequence
  Description of Artificial Sequence: Synthetic peptide
  Seed: QRPILTIITL (TP53 R248Q)
QLPILTIITM

SEQ ID NO: 19986 - protein, 10 aa, Artificial Sequence
  Description of Artificial Sequence: Synthetic peptide
  Seed: QRPILTIITL (TP53 R248Q)
QLPILTIITV

SEQ ID NO: 19987 - protein, 10 aa, Artificial Sequence
  Description of Artificial Sequence: Synthetic peptide
  Seed: QRPILTIITL (TP53 R248Q)
QMPILTIITA

SEQ ID NO: 19988 - protein, 10 aa, Artificial Sequence
  Description of Artificial Sequence: Synthetic peptide
  Seed: QRPILTIITL (TP53 R248Q)
QMPILTIITF

SEQ ID NO: 19989 - protein, 10 aa, Artificial Sequence
  Description of Artificial Sequence: Synthetic peptide
  Seed: QRPILTIITL (TP53 R248Q)
QMPILTIITI

SEQ ID NO: 19990 - protein, 10 aa, Artificial Sequence
  Description of Artificial Sequence: Synthetic peptide
  Seed: QRPILTIITL (TP53 R248Q)
QMPILTIITL

SEQ ID NO: 19991 - protein, 10 aa, Artificial Sequence
  Description of Artificial Sequence: Synthetic peptide
  Seed: QRPILTIITL (TP53 R248Q)
QMPILTIITM

SEQ ID NO: 19992 - protein, 10 aa, Artificial Sequence
  Description of Artificial Sequence: Synthetic peptide
  Seed: QRPILTIITL (TP53 R248Q)
QMPILTIITV

SEQ ID NO: 19993 - protein, 10 aa, Artificial Sequence
  Description of Artificial Sequence: Synthetic peptide
  Seed: QRPILTIITL (TP53 R248Q)
QNPILTIITF

SEQ ID NO: 19994 - protein, 10 aa, Artificial Sequence
  Description of Artificial Sequence: Synthetic peptide
  Seed: QRPILTIITL (TP53 R248Q)
QNPILTIITL

SEQ ID NO: 19995 - protein, 10 aa, Artificial Sequence
  Description of Artificial Sequence: Synthetic peptide
  Seed: QRPILTIITL (TP53 R248Q)
QNPILTIITM

SEQ ID NO: 19996 - protein, 10 aa, Artificial Sequence
  Description of Artificial Sequence: Synthetic peptide
  Seed: QRPILTIITL (TP53 R248Q)
QPPILTIITF

SEQ ID NO: 19997 - protein, 10 aa, Artificial Sequence
  Description of Artificial Sequence: Synthetic peptide
  Seed: QRPILTIITL (TP53 R248Q)
QPPILTIITL

SEQ ID NO: 19998 - protein, 10 aa, Artificial Sequence
  Description of Artificial Sequence: Synthetic peptide
  Seed: QRPILTIITL (TP53 R248Q)
QPPILTIITM

SEQ ID NO: 19999 - protein, 10 aa, Artificial Sequence
  Description of Artificial Sequence: Synthetic peptide
  Seed: QRPILTIITL (TP53 R248Q)
QQPILTIITF

SEQ ID NO: 20000 - protein, 10 aa, Artificial Sequence
  Description of Artificial Sequence: Synthetic peptide
  Seed: QRPILTIITL (TP53 R248Q)
QQPILTIITL

SEQ ID NO: 20001 - protein, 10 aa, Artificial Sequence
  Description of Artificial Sequence: Synthetic peptide
  Seed: QRPILTIITL (TP53 R248Q)
QQPILTIITM

SEQ ID NO: 20002 - protein, 10 aa, Artificial Sequence
  Description of Artificial Sequence: Synthetic peptide
  Seed: QRPILTIITL (TP53 R248Q)
QRPILTIITF

SEQ ID NO: 20003 - protein, 10 aa, Artificial Sequence
  Description of Artificial Sequence: Synthetic peptide
  Seed: QRPILTIITL (TP53 R248Q)
QRPILTIITI

SEQ ID NO: 20004 - protein, 10 aa, Artificial Sequence
  Description of Artificial Sequence: Synthetic peptide
  Seed: QRPILTIITL (TP53 R248Q)
QRPILTIITK

SEQ ID NO: 20005 - protein, 10 aa, Artificial Sequence
  Description of Artificial Sequence: Synthetic peptide
  Seed: QRPILTIITL (TP53 R248Q)
QRPILTIITM

SEQ ID NO: 20006 - protein, 10 aa, Artificial Sequence
  Description of Artificial Sequence: Synthetic peptide
  Seed: QRPILTIITL (TP53 R248Q)
QRPILTIITR

SEQ ID NO: 20007 - protein, 10 aa, Artificial Sequence
  Description of Artificial Sequence: Synthetic peptide
  Seed: QRPILTIITL (TP53 R248Q)
QRPILTIITV

SEQ ID NO: 20008 - protein, 10 aa, Artificial Sequence
  Description of Artificial Sequence: Synthetic peptide
  Seed: QRPILTIITL (TP53 R248Q)
QSPILTIITF

SEQ ID NO: 20009 - protein, 10 aa, Artificial Sequence
  Description of Artificial Sequence: Synthetic peptide
  Seed: QRPILTIITL (TP53 R248Q)
QSPILTIITL

SEQ ID NO: 20010 - protein, 10 aa, Artificial Sequence
  Description of Artificial Sequence: Synthetic peptide
  Seed: QRPILTIITL (TP53 R248Q)
QSPILTIITM

SEQ ID NO: 20011 - protein, 10 aa, Artificial Sequence
  Description of Artificial Sequence: Synthetic peptide
  Seed: QRPILTIITL (TP53 R248Q)
QSPILTIITV

SEQ ID NO: 20012 - protein, 10 aa, Artificial Sequence
  Description of Artificial Sequence: Synthetic peptide
  Seed: QRPILTIITL (TP53 R248Q)
QTPILTIITF

SEQ ID NO: 20013 - protein, 10 aa, Artificial Sequence
  Description of Artificial Sequence: Synthetic peptide
  Seed: QRPILTIITL (TP53 R248Q)
QTPILTIITL

SEQ ID NO: 20014 - protein, 10 aa, Artificial Sequence
  Description of Artificial Sequence: Synthetic peptide
  Seed: QRPILTIITL (TP53 R248Q)
QTPILTIITM

SEQ ID NO: 20015 - protein, 10 aa, Artificial Sequence
  Description of Artificial Sequence: Synthetic peptide
  Seed: QRPILTIITL (TP53 R248Q)
QVPILTIITF

SEQ ID NO: 20016 - protein, 10 aa, Artificial Sequence
  Description of Artificial Sequence: Synthetic peptide
  Seed: QRPILTIITL (TP53 R248Q)
QVPILTIITL

SEQ ID NO: 20017 - protein, 10 aa, Artificial Sequence
  Description of Artificial Sequence: Synthetic peptide
  Seed: QRPILTIITL (TP53 R248Q)
QVPILTIITM

SEQ ID NO: 20018 - protein, 10 aa, Artificial Sequence
  Description of Artificial Sequence: Synthetic peptide
  Seed: QRPILTIITL (TP53 R248Q)
QWPILTIITF

SEQ ID NO: 20019 - protein, 10 aa, Artificial Sequence
  Description of Artificial Sequence: Synthetic peptide
  Seed: QRPILTIITL (TP53 R248Q)
QWPILTIITI

SEQ ID NO: 20020 - protein, 10 aa, Artificial Sequence
  Description of Artificial Sequence: Synthetic peptide
  Seed: QRPILTIITL (TP53 R248Q)
QWPILTIITL

SEQ ID NO: 20021 - protein, 10 aa, Artificial Sequence
  Description of Artificial Sequence: Synthetic peptide
  Seed: QRPILTIITL (TP53 R248Q)
QWPILTIITM

SEQ ID NO: 20022 - protein, 10 aa, Artificial Sequence
  Description of Artificial Sequence: Synthetic peptide
  Seed: QRPILTIITL (TP53 R248Q)
QWPILTIITV

SEQ ID NO: 20023 - protein, 10 aa, Artificial Sequence
  Description of Artificial Sequence: Synthetic peptide
  Seed: QRPILTIITL (TP53 R248Q)
QYPILTIITA

SEQ ID NO: 20024 - protein, 10 aa, Artificial Sequence
  Description of Artificial Sequence: Synthetic peptide
  Seed: QRPILTIITL (TP53 R248Q)
QYPILTIITF

SEQ ID NO: 20025 - protein, 10 aa, Artificial Sequence
  Description of Artificial Sequence: Synthetic peptide
  Seed: QRPILTIITL (TP53 R248Q)
QYPILTIITI

SEQ ID NO: 20026 - protein, 10 aa, Artificial Sequence
  Description of Artificial Sequence: Synthetic peptide
  Seed: QRPILTIITL (TP53 R248Q)
QYPILTIITL

SEQ ID NO: 20027 - protein, 10 aa, Artificial Sequence
  Description of Artificial Sequence: Synthetic peptide
  Seed: QRPILTIITL (TP53 R248Q)
QYPILTIITM

SEQ ID NO: 20028 - protein, 10 aa, Artificial Sequence
  Description of Artificial Sequence: Synthetic peptide
  Seed: QRPILTIITL (TP53 R248Q)
QYPILTIITV

SEQ ID NO: 20029 - protein, 10 aa, Artificial Sequence
  Description of Artificial Sequence: Synthetic peptide
  Seed: SSCMGGMNQR (TP53 R248Q)
SACMGGMNQK

SEQ ID NO: 20030 - protein, 10 aa, Artificial Sequence
  Description of Artificial Sequence: Synthetic peptide
  Seed: SSCMGGMNQR (TP53 R248Q)
SACMGGMNQR

SEQ ID NO: 20031 - protein, 9 aa, Artificial Sequence
  Description of Artificial Sequence: Synthetic peptide
  Seed: SCMGGMNQR (TP53 R248Q)
SAMGGMNQK

SEQ ID NO: 20032 - protein, 9 aa, Artificial Sequence
  Description of Artificial Sequence: Synthetic peptide
  Seed: SCMGGMNQR (TP53 R248Q)
SAMGGMNQR

SEQ ID NO: 20033 - protein, 9 aa, Artificial Sequence
  Description of Artificial Sequence: Synthetic peptide
  Seed: SCMGGMNQR (TP53 R248Q)
SAMGGMNQY

SEQ ID NO: 20034 - protein, 10 aa, Artificial Sequence
  Description of Artificial Sequence: Synthetic peptide
  Seed: SSCMGGMNQR (TP53 R248Q)
SFCMGGMNQK

SEQ ID NO: 20035 - protein, 10 aa, Artificial Sequence
  Description of Artificial Sequence: Synthetic peptide
  Seed: SSCMGGMNQR (TP53 R248Q)
SFCMGGMNQR

SEQ ID NO: 20036 - protein, 9 aa, Artificial Sequence
  Description of Artificial Sequence: Synthetic peptide
  Seed: SCMGGMNQR (TP53 R248Q)
SFMGGMNQK

SEQ ID NO: 20037 - protein, 9 aa, Artificial Sequence
  Description of Artificial Sequence: Synthetic peptide
  Seed: SCMGGMNQR (TP53 R248Q)
SFMGGMNQR

SEQ ID NO: 20038 - protein, 10 aa, Artificial Sequence
  Description of Artificial Sequence: Synthetic peptide
  Seed: SSCMGGMNQR (TP53 R248Q)
SGCMGGMNQK

SEQ ID NO: 20039 - protein, 10 aa, Artificial Sequence
  Description of Artificial Sequence: Synthetic peptide
  Seed: SSCMGGMNQR (TP53 R248Q)
SGCMGGMNQR

SEQ ID NO: 20040 - protein, 9 aa, Artificial Sequence
  Description of Artificial Sequence: Synthetic peptide
  Seed: SCMGGMNQR (TP53 R248Q)
SGMGGMNQK

SEQ ID NO: 20041 - protein, 9 aa, Artificial Sequence
  Description of Artificial Sequence: Synthetic peptide
  Seed: SCMGGMNQR (TP53 R248Q)
SGMGGMNQR

SEQ ID NO: 20042 - protein, 10 aa, Artificial Sequence
  Description of Artificial Sequence: Synthetic peptide
  Seed: SSCMGGMNQR (TP53 R248Q)
SHCMGGMNQR

SEQ ID NO: 20043 - protein, 9 aa, Artificial Sequence
  Description of Artificial Sequence: Synthetic peptide
  Seed: SCMGGMNQR (TP53 R248Q)
SHMGGMNQR

SEQ ID NO: 20044 - protein, 10 aa, Artificial Sequence
  Description of Artificial Sequence: Synthetic peptide
  Seed: SSCMGGMNQR (TP53 R248Q)
SICMGGMNQK

SEQ ID NO: 20045 - protein, 10 aa, Artificial Sequence
  Description of Artificial Sequence: Synthetic peptide
  Seed: SSCMGGMNQR (TP53 R248Q)
SICMGGMNQR

SEQ ID NO: 20046 - protein, 10 aa, Artificial Sequence
  Description of Artificial Sequence: Synthetic peptide
  Seed: SSCMGGMNQR (TP53 R248Q)
SICMGGMNQY

SEQ ID NO: 20047 - protein, 9 aa, Artificial Sequence
  Description of Artificial Sequence: Synthetic peptide
  Seed: SCMGGMNQR (TP53 R248Q)
SIMGGMNQK

SEQ ID NO: 20048 - protein, 9 aa, Artificial Sequence
  Description of Artificial Sequence: Synthetic peptide
  Seed: SCMGGMNQR (TP53 R248Q)
SIMGGMNQR

SEQ ID NO: 20049 - protein, 9 aa, Artificial Sequence
  Description of Artificial Sequence: Synthetic peptide
  Seed: SCMGGMNQR (TP53 R248Q)
SIMGGMNQY

SEQ ID NO: 20050 - protein, 10 aa, Artificial Sequence
  Description of Artificial Sequence: Synthetic peptide
  Seed: SSCMGGMNQR (TP53 R248Q)
SLCMGGMNQK

SEQ ID NO: 20051 - protein, 10 aa, Artificial Sequence
  Description of Artificial Sequence: Synthetic peptide
  Seed: SSCMGGMNQR (TP53 R248Q)
SLCMGGMNQR

SEQ ID NO: 20052 - protein, 9 aa, Artificial Sequence
  Description of Artificial Sequence: Synthetic peptide
  Seed: SCMGGMNQR (TP53 R248Q)
SLMGGMNQK

SEQ ID NO: 20053 - protein, 9 aa, Artificial Sequence
  Description of Artificial Sequence: Synthetic peptide
  Seed: SCMGGMNQR (TP53 R248Q)
SLMGGMNQR

SEQ ID NO: 20054 - protein, 10 aa, Artificial Sequence
  Description of Artificial Sequence: Synthetic peptide
  Seed: SSCMGGMNQR (TP53 R248Q)
SMCMGGMNQK

SEQ ID NO: 20055 - protein, 10 aa, Artificial Sequence
  Description of Artificial Sequence: Synthetic peptide
  Seed: SSCMGGMNQR (TP53 R248Q)
SMCMGGMNQR

SEQ ID NO: 20056 - protein, 9 aa, Artificial Sequence
  Description of Artificial Sequence: Synthetic peptide
  Seed: SCMGGMNQR (TP53 R248Q)
SMMGGMNQK

SEQ ID NO: 20057 - protein, 9 aa, Artificial Sequence
  Description of Artificial Sequence: Synthetic peptide
  Seed: SCMGGMNQR (TP53 R248Q)
SMMGGMNQR

SEQ ID NO: 20058 - protein, 10 aa, Artificial Sequence
  Description of Artificial Sequence: Synthetic peptide
  Seed: SSCMGGMNQR (TP53 R248Q)
SNCMGGMNQR

SEQ ID NO: 20059 - protein, 9 aa, Artificial Sequence
  Description of Artificial Sequence: Synthetic peptide
  Seed: SCMGGMNQR (TP53 R248Q)
SNMGGMNQK

SEQ ID NO: 20060 - protein, 9 aa, Artificial Sequence
  Description of Artificial Sequence: Synthetic peptide
  Seed: SCMGGMNQR (TP53 R248Q)
SNMGGMNQR

SEQ ID NO: 20061 - protein, 9 aa, Artificial Sequence
  Description of Artificial Sequence: Synthetic peptide
  Seed: SCMGGMNQR (TP53 R248Q)
SPMGGMNQR

SEQ ID NO: 20062 - protein, 10 aa, Artificial Sequence
  Description of Artificial Sequence: Synthetic peptide
  Seed: SSCMGGMNQR (TP53 R248Q)
SQCMGGMNQK

SEQ ID NO: 20063 - protein, 10 aa, Artificial Sequence
  Description of Artificial Sequence: Synthetic peptide
  Seed: SSCMGGMNQR (TP53 R248Q)
SQCMGGMNQR

SEQ ID NO: 20064 - protein, 9 aa, Artificial Sequence
  Description of Artificial Sequence: Synthetic peptide
  Seed: SCMGGMNQR (TP53 R248Q)
SQMGGMNQK

SEQ ID NO: 20065 - protein, 9 aa, Artificial Sequence
  Description of Artificial Sequence: Synthetic peptide
  Seed: SCMGGMNQR (TP53 R248Q)
SQMGGMNQR

SEQ ID NO: 20066 - protein, 10 aa, Artificial Sequence
  Description of Artificial Sequence: Synthetic peptide
  Seed: SSCMGGMNQR (TP53 R248Q)
SSCMGGMNQK

SEQ ID NO: 20067 - protein, 10 aa, Artificial Sequence
  Description of Artificial Sequence: Synthetic peptide
  Seed: SSCMGGMNQR (TP53 R248Q)
SSCMGGMNQY

SEQ ID NO: 20068 - protein, 9 aa, Artificial Sequence
  Description of Artificial Sequence: Synthetic peptide
  Seed: SCMGGMNQR (TP53 R248Q)
SSMGGMNQK

SEQ ID NO: 20069 - protein, 9 aa, Artificial Sequence
  Description of Artificial Sequence: Synthetic peptide
  Seed: SCMGGMNQR (TP53 R248Q)
SSMGGMNQR

SEQ ID NO: 20070 - protein, 9 aa, Artificial Sequence
  Description of Artificial Sequence: Synthetic peptide
  Seed: SCMGGMNQR (TP53 R248Q)
SSMGGMNQY

SEQ ID NO: 20071 - protein, 10 aa, Artificial Sequence
  Description of Artificial Sequence: Synthetic peptide
  Seed: SSCMGGMNQR (TP53 R248Q)
STCMGGMNQR

SEQ ID NO: 20072 - protein, 9 aa, Artificial Sequence
  Description of Artificial Sequence: Synthetic peptide
  Seed: SCMGGMNQR (TP53 R248Q)
STMGGMNQK

SEQ ID NO: 20073 - protein, 9 aa, Artificial Sequence
  Description of Artificial Sequence: Synthetic peptide
  Seed: SCMGGMNQR (TP53 R248Q)
STMGGMNQY

SEQ ID NO: 20074 - protein, 10 aa, Artificial Sequence
  Description of Artificial Sequence: Synthetic peptide
  Seed: SSCMGGMNQR (TP53 R248Q)
SVCMGGMNQR

SEQ ID NO: 20075 - protein, 10 aa, Artificial Sequence
  Description of Artificial Sequence: Synthetic peptide
  Seed: SSCMGGMNQR (TP53 R248Q)
SVCMGGMNQY

SEQ ID NO: 20076 - protein, 9 aa, Artificial Sequence
  Description of Artificial Sequence: Synthetic peptide
  Seed: SCMGGMNQR (TP53 R248Q)
SVMGGMNQK

SEQ ID NO: 20077 - protein, 9 aa, Artificial Sequence
  Description of Artificial Sequence: Synthetic peptide
  Seed: SCMGGMNQR (TP53 R248Q)
SVMGGMNQY

SEQ ID NO: 20078 - protein, 10 aa, Artificial Sequence
  Description of Artificial Sequence: Synthetic peptide
  Seed: SSCMGGMNQR (TP53 R248Q)
SWCMGGMNQK

SEQ ID NO: 20079 - protein, 10 aa, Artificial Sequence
  Description of Artificial Sequence: Synthetic peptide
  Seed: SSCMGGMNQR (TP53 R248Q)
SWCMGGMNQR

SEQ ID NO: 20080 - protein, 9 aa, Artificial Sequence
  Description of Artificial Sequence: Synthetic peptide
  Seed: SCMGGMNQR (TP53 R248Q)
SWMGGMNQK

SEQ ID NO: 20081 - protein, 9 aa, Artificial Sequence
  Description of Artificial Sequence: Synthetic peptide
  Seed: SCMGGMNQR (TP53 R248Q)
SWMGGMNQR

SEQ ID NO: 20082 - protein, 10 aa, Artificial Sequence
  Description of Artificial Sequence: Synthetic peptide
  Seed: SSCMGGMNQR (TP53 R248Q)
SYCMGGMNQK

SEQ ID NO: 20083 - protein, 10 aa, Artificial Sequence
  Description of Artificial Sequence: Synthetic peptide
  Seed: SSCMGGMNQR (TP53 R248Q)
SYCMGGMNQR

SEQ ID NO: 20084 - protein, 9 aa, Artificial Sequence
  Description of Artificial Sequence: Synthetic peptide
  Seed: SCMGGMNQR (TP53 R248Q)
SYMGGMNQK

SEQ ID NO: 20085 - protein, 9 aa, Artificial Sequence
  Description of Artificial Sequence: Synthetic peptide
  Seed: SCMGGMNQR (TP53 R248Q)
SYMGGMNQR

SEQ ID NO: 20086 - protein, 9 aa, Artificial Sequence
  Description of Artificial Sequence: Synthetic peptide
  Seed: GGMNQRPIL (TP53 R248Q)
GAMNQRPIL

SEQ ID NO: 20087 - protein, 9 aa, Artificial Sequence
  Description of Artificial Sequence: Synthetic peptide
  Seed: GGMNQRPIL (TP53 R248Q)
GAMNQRPIM

SEQ ID NO: 20088 - protein, 8 aa, Artificial Sequence
  Description of Artificial Sequence: Synthetic peptide
  Seed: GMNQRPIL (TP53 R248Q)
GANQRPIL

SEQ ID NO: 20089 - protein, 10 aa, Artificial Sequence
  Description of Artificial Sequence: Synthetic peptide
  Seed: GMNQRPILTI (TP53 R248Q)
GANQRPILTF

SEQ ID NO: 20090 - protein, 10 aa, Artificial Sequence
  Description of Artificial Sequence: Synthetic peptide
  Seed: GMNQRPILTI (TP53 R248Q)
GANQRPILTL

SEQ ID NO: 20091 - protein, 9 aa, Artificial Sequence
  Description of Artificial Sequence: Synthetic peptide
  Seed: GGMNQRPIL (TP53 R248Q)
GCMNQRPIL

SEQ ID NO: 20092 - protein, 10 aa, Artificial Sequence
  Description of Artificial Sequence: Synthetic peptide
  Seed: GMNQRPILTI (TP53 R248Q)
GCNQRPILTL

SEQ ID NO: 20093 - protein, 9 aa, Artificial Sequence
  Description of Artificial Sequence: Synthetic peptide
  Seed: GGMNQRPIL (TP53 R248Q)
GDMNQRPIL

SEQ ID NO: 20094 - protein, 10 aa, Artificial Sequence
  Description of Artificial Sequence: Synthetic peptide
  Seed: GMNQRPILTI (TP53 R248Q)
GDNQRPILTL

SEQ ID NO: 20095 - protein, 9 aa, Artificial Sequence
  Description of Artificial Sequence: Synthetic peptide
  Seed: GGMNQRPIL (TP53 R248Q)
GEMNQRPIK

SEQ ID NO: 20096 - protein, 9 aa, Artificial Sequence
  Description of Artificial Sequence: Synthetic peptide
  Seed: GGMNQRPIL (TP53 R248Q)
GEMNQRPIL

SEQ ID NO: 20097 - protein, 9 aa, Artificial Sequence
  Description of Artificial Sequence: Synthetic peptide
  Seed: GGMNQRPIL (TP53 R248Q)
GEMNQRPIM

SEQ ID NO: 20098 - protein, 10 aa, Artificial Sequence
  Description of Artificial Sequence: Synthetic peptide
  Seed: GMNQRPILTI (TP53 R248Q)
GENQRPILTF

SEQ ID NO: 20099 - protein, 10 aa, Artificial Sequence
  Description of Artificial Sequence: Synthetic peptide
  Seed: GMNQRPILTI (TP53 R248Q)
GENQRPILTI

SEQ ID NO: 20100 - protein, 10 aa, Artificial Sequence
  Description of Artificial Sequence: Synthetic peptide
  Seed: GMNQRPILTI (TP53 R248Q)
GENQRPILTK

SEQ ID NO: 20101 - protein, 10 aa, Artificial Sequence
  Description of Artificial Sequence: Synthetic peptide
  Seed: GMNQRPILTI (TP53 R248Q)
GENQRPILTL

SEQ ID NO: 20102 - protein, 10 aa, Artificial Sequence
  Description of Artificial Sequence: Synthetic peptide
  Seed: GMNQRPILTI (TP53 R248Q)
GENQRPILTV

SEQ ID NO: 20103 - protein, 9 aa, Artificial Sequence
  Description of Artificial Sequence: Synthetic peptide
  Seed: GGMNQRPIL (TP53 R248Q)
GGMNQRPIF

SEQ ID NO: 20104 - protein, 9 aa, Artificial Sequence
  Description of Artificial Sequence: Synthetic peptide
  Seed: GGMNQRPIL (TP53 R248Q)
GGMNQRPII

SEQ ID NO: 20105 - protein, 9 aa, Artificial Sequence
  Description of Artificial Sequence: Synthetic peptide
  Seed: GGMNQRPIL (TP53 R248Q)
GGMNQRPIK

SEQ ID NO: 20106 - protein, 10 aa, Artificial Sequence
  Description of Artificial Sequence: Synthetic peptide
  Seed: GMNQRPILTI (TP53 R248Q)
GGNQRPILTF

SEQ ID NO: 20107 - protein, 10 aa, Artificial Sequence
  Description of Artificial Sequence: Synthetic peptide
  Seed: GMNQRPILTI (TP53 R248Q)
GGNQRPILTI

SEQ ID NO: 20108 - protein, 10 aa, Artificial Sequence
  Description of Artificial Sequence: Synthetic peptide
  Seed: GMNQRPILTI (TP53 R248Q)
GGNQRPILTK

SEQ ID NO: 20109 - protein, 10 aa, Artificial Sequence
  Description of Artificial Sequence: Synthetic peptide
  Seed: GMNQRPILTI (TP53 R248Q)
GGNQRPILTL

SEQ ID NO: 20110 - protein, 10 aa, Artificial Sequence
  Description of Artificial Sequence: Synthetic peptide
  Seed: GMNQRPILTI (TP53 R248Q)
GGNQRPILTM

SEQ ID NO: 20111 - protein, 10 aa, Artificial Sequence
  Description of Artificial Sequence: Synthetic peptide
  Seed: GMNQRPILTI (TP53 R248Q)
GGNQRPILTR

SEQ ID NO: 20112 - protein, 9 aa, Artificial Sequence
  Description of Artificial Sequence: Synthetic peptide
  Seed: GGMNQRPIL (TP53 R248Q)
GHMNQRPIL

SEQ ID NO: 20113 - protein, 9 aa, Artificial Sequence
  Description of Artificial Sequence: Synthetic peptide
  Seed: GGMNQRPIL (TP53 R248Q)
GHMNQRPIM

SEQ ID NO: 20114 - protein, 9 aa, Artificial Sequence
  Description of Artificial Sequence: Synthetic peptide
  Seed: GGMNQRPIL (TP53 R248Q)
GIMNQRPIL

SEQ ID NO: 20115 - protein, 8 aa, Artificial Sequence
  Description of Artificial Sequence: Synthetic peptide
  Seed: GMNQRPIL (TP53 R248Q)
GINQRPIL

SEQ ID NO: 20116 - protein, 10 aa, Artificial Sequence
  Description of Artificial Sequence: Synthetic peptide
  Seed: GMNQRPILTI (TP53 R248Q)
GINQRPILTF

SEQ ID NO: 20117 - protein, 10 aa, Artificial Sequence
  Description of Artificial Sequence: Synthetic peptide
  Seed: GMNQRPILTI (TP53 R248Q)
GINQRPILTI

SEQ ID NO: 20118 - protein, 10 aa, Artificial Sequence
  Description of Artificial Sequence: Synthetic peptide
  Seed: GMNQRPILTI (TP53 R248Q)
GINQRPILTL

SEQ ID NO: 20119 - protein, 10 aa, Artificial Sequence
  Description of Artificial Sequence: Synthetic peptide
  Seed: GMNQRPILTI (TP53 R248Q)
GINQRPILTW

SEQ ID NO: 20120 - protein, 9 aa, Artificial Sequence
  Description of Artificial Sequence: Synthetic peptide
  Seed: GGMNQRPIL (TP53 R248Q)
GKMNQRPIK

SEQ ID NO: 20121 - protein, 9 aa, Artificial Sequence
  Description of Artificial Sequence: Synthetic peptide
  Seed: GGMNQRPIL (TP53 R248Q)
GKMNQRPIL

SEQ ID NO: 20122 - protein, 10 aa, Artificial Sequence
  Description of Artificial Sequence: Synthetic peptide
  Seed: GMNQRPILTI (TP53 R248Q)
GKNQRPILTF

SEQ ID NO: 20123 - protein, 10 aa, Artificial Sequence
  Description of Artificial Sequence: Synthetic peptide
  Seed: GMNQRPILTI (TP53 R248Q)
GKNQRPILTK

SEQ ID NO: 20124 - protein, 10 aa, Artificial Sequence
  Description of Artificial Sequence: Synthetic peptide
  Seed: GMNQRPILTI (TP53 R248Q)
GKNQRPILTL

SEQ ID NO: 20125 - protein, 10 aa, Artificial Sequence
  Description of Artificial Sequence: Synthetic peptide
  Seed: GMNQRPILTI (TP53 R248Q)
GKNQRPILTY

SEQ ID NO: 20126 - protein, 9 aa, Artificial Sequence
  Description of Artificial Sequence: Synthetic peptide
  Seed: GGMNQRPIL (TP53 R248Q)
GLMNQRPIL

SEQ ID NO: 20127 - protein, 8 aa, Artificial Sequence
  Description of Artificial Sequence: Synthetic peptide
  Seed: GMNQRPIL (TP53 R248Q)
GLNQRPIL

SEQ ID NO: 20128 - protein, 10 aa, Artificial Sequence
  Description of Artificial Sequence: Synthetic peptide
  Seed: GMNQRPILTI (TP53 R248Q)
GLNQRPILTF

SEQ ID NO: 20129 - protein, 10 aa, Artificial Sequence
  Description of Artificial Sequence: Synthetic peptide
  Seed: GMNQRPILTI (TP53 R248Q)
GLNQRPILTM

SEQ ID NO: 20130 - protein, 10 aa, Artificial Sequence
  Description of Artificial Sequence: Synthetic peptide
  Seed: GMNQRPILTI (TP53 R248Q)
GLNQRPILTW

SEQ ID NO: 20131 - protein, 9 aa, Artificial Sequence
  Description of Artificial Sequence: Synthetic peptide
  Seed: GGMNQRPIL (TP53 R248Q)
GMMNQRPIL

SEQ ID NO: 20132 - protein, 10 aa, Artificial Sequence
  Description of Artificial Sequence: Synthetic peptide
  Seed: GMNQRPILTI (TP53 R248Q)
GMNQRPILTF

SEQ ID NO: 20133 - protein, 10 aa, Artificial Sequence
  Description of Artificial Sequence: Synthetic peptide
  Seed: GMNQRPILTI (TP53 R248Q)
GMNQRPILTW

SEQ ID NO: 20134 - protein, 9 aa, Artificial Sequence
  Description of Artificial Sequence: Synthetic peptide
  Seed: GGMNQRPIL (TP53 R248Q)
GNMNQRPIK

SEQ ID NO: 20135 - protein, 9 aa, Artificial Sequence
  Description of Artificial Sequence: Synthetic peptide
  Seed: GGMNQRPIL (TP53 R248Q)
GNMNQRPIL

SEQ ID NO: 20136 - protein, 10 aa, Artificial Sequence
  Description of Artificial Sequence: Synthetic peptide
  Seed: GMNQRPILTI (TP53 R248Q)
GNNQRPILTF

SEQ ID NO: 20137 - protein, 10 aa, Artificial Sequence
  Description of Artificial Sequence: Synthetic peptide
  Seed: GMNQRPILTI (TP53 R248Q)
GNNQRPILTK

SEQ ID NO: 20138 - protein, 10 aa, Artificial Sequence
  Description of Artificial Sequence: Synthetic peptide
  Seed: GMNQRPILTI (TP53 R248Q)
GNNQRPILTL

SEQ ID NO: 20139 - protein, 8 aa, Artificial Sequence
  Description of Artificial Sequence: Synthetic peptide
  Seed: GMNQRPIL (TP53 R248Q)
GPNQRPII

SEQ ID NO: 20140 - protein, 8 aa, Artificial Sequence
  Description of Artificial Sequence: Synthetic peptide
  Seed: GMNQRPIL (TP53 R248Q)
GPNQRPIL

SEQ ID NO: 20141 - protein, 10 aa, Artificial Sequence
  Description of Artificial Sequence: Synthetic peptide
  Seed: GMNQRPILTI (TP53 R248Q)
GPNQRPILTL

SEQ ID NO: 20142 - protein, 8 aa, Artificial Sequence
  Description of Artificial Sequence: Synthetic peptide
  Seed: GMNQRPIL (TP53 R248Q)
GPNQRPIM

SEQ ID NO: 20143 - protein, 9 aa, Artificial Sequence
  Description of Artificial Sequence: Synthetic peptide
  Seed: GGMNQRPIL (TP53 R248Q)
GQMNQRPIF

SEQ ID NO: 20144 - protein, 9 aa, Artificial Sequence
  Description of Artificial Sequence: Synthetic peptide
  Seed: GGMNQRPIL (TP53 R248Q)
GQMNQRPII

SEQ ID NO: 20145 - protein, 9 aa, Artificial Sequence
  Description of Artificial Sequence: Synthetic peptide
  Seed: GGMNQRPIL (TP53 R248Q)
GQMNQRPIK

SEQ ID NO: 20146 - protein, 9 aa, Artificial Sequence
  Description of Artificial Sequence: Synthetic peptide
  Seed: GGMNQRPIL (TP53 R248Q)
GQMNQRPIL

SEQ ID NO: 20147 - protein, 9 aa, Artificial Sequence
  Description of Artificial Sequence: Synthetic peptide
  Seed: GGMNQRPIL (TP53 R248Q)
GQMNQRPIM

SEQ ID NO: 20148 - protein, 9 aa, Artificial Sequence
  Description of Artificial Sequence: Synthetic peptide
  Seed: GGMNQRPIL (TP53 R248Q)
GQMNQRPIR

SEQ ID NO: 20149 - protein, 9 aa, Artificial Sequence
  Description of Artificial Sequence: Synthetic peptide
  Seed: GGMNQRPIL (TP53 R248Q)
GQMNQRPIV

SEQ ID NO: 20150 - protein, 9 aa, Artificial Sequence
  Description of Artificial Sequence: Synthetic peptide
  Seed: GGMNQRPIL (TP53 R248Q)
GQMNQRPIY

SEQ ID NO: 20151 - protein, 10 aa, Artificial Sequence
  Description of Artificial Sequence: Synthetic peptide
  Seed: GMNQRPILTI (TP53 R248Q)
GQNQRPILTA

SEQ ID NO: 20152 - protein, 10 aa, Artificial Sequence
  Description of Artificial Sequence: Synthetic peptide
  Seed: GMNQRPILTI (TP53 R248Q)
GQNQRPILTC

SEQ ID NO: 20153 - protein, 10 aa, Artificial Sequence
  Description of Artificial Sequence: Synthetic peptide
  Seed: GMNQRPILTI (TP53 R248Q)
GQNQRPILTF

SEQ ID NO: 20154 - protein, 10 aa, Artificial Sequence
  Description of Artificial Sequence: Synthetic peptide
  Seed: GMNQRPILTI (TP53 R248Q)
GQNQRPILTI

SEQ ID NO: 20155 - protein, 10 aa, Artificial Sequence
  Description of Artificial Sequence: Synthetic peptide
  Seed: GMNQRPILTI (TP53 R248Q)
GQNQRPILTK

SEQ ID NO: 20156 - protein, 10 aa, Artificial Sequence
  Description of Artificial Sequence: Synthetic peptide
  Seed: GMNQRPILTI (TP53 R248Q)
GQNQRPILTL

SEQ ID NO: 20157 - protein, 10 aa, Artificial Sequence
  Description of Artificial Sequence: Synthetic peptide
  Seed: GMNQRPILTI (TP53 R248Q)
GQNQRPILTM

SEQ ID NO: 20158 - protein, 10 aa, Artificial Sequence
  Description of Artificial Sequence: Synthetic peptide
  Seed: GMNQRPILTI (TP53 R248Q)
GQNQRPILTR

SEQ ID NO: 20159 - protein, 10 aa, Artificial Sequence
  Description of Artificial Sequence: Synthetic peptide
  Seed: GMNQRPILTI (TP53 R248Q)
GQNQRPILTW

SEQ ID NO: 20160 - protein, 10 aa, Artificial Sequence
  Description of Artificial Sequence: Synthetic peptide
  Seed: GMNQRPILTI (TP53 R248Q)
GQNQRPILTY

SEQ ID NO: 20161 - protein, 9 aa, Artificial Sequence
  Description of Artificial Sequence: Synthetic peptide
  Seed: GGMNQRPIL (TP53 R248Q)
GRMNQRPIA

SEQ ID NO: 20162 - protein, 9 aa, Artificial Sequence
  Description of Artificial Sequence: Synthetic peptide
  Seed: GGMNQRPIL (TP53 R248Q)
GRMNQRPIC

SEQ ID NO: 20163 - protein, 9 aa, Artificial Sequence
  Description of Artificial Sequence: Synthetic peptide
  Seed: GGMNQRPIL (TP53 R248Q)
GRMNQRPIE

SEQ ID NO: 20164 - protein, 9 aa, Artificial Sequence
  Description of Artificial Sequence: Synthetic peptide
  Seed: GGMNQRPIL (TP53 R248Q)
GRMNQRPIF

SEQ ID NO: 20165 - protein, 9 aa, Artificial Sequence
  Description of Artificial Sequence: Synthetic peptide
  Seed: GGMNQRPIL (TP53 R248Q)
GRMNQRPIG

SEQ ID NO: 20166 - protein, 9 aa, Artificial Sequence
  Description of Artificial Sequence: Synthetic peptide
  Seed: GGMNQRPIL (TP53 R248Q)
GRMNQRPIH

SEQ ID NO: 20167 - protein, 9 aa, Artificial Sequence
  Description of Artificial Sequence: Synthetic peptide
  Seed: GGMNQRPIL (TP53 R248Q)
GRMNQRPII

SEQ ID NO: 20168 - protein, 9 aa, Artificial Sequence
  Description of Artificial Sequence: Synthetic peptide
  Seed: GGMNQRPIL (TP53 R248Q)
GRMNQRPIK

SEQ ID NO: 20169 - protein, 9 aa, Artificial Sequence
  Description of Artificial Sequence: Synthetic peptide
  Seed: GGMNQRPIL (TP53 R248Q)
GRMNQRPIL

SEQ ID NO: 20170 - protein, 9 aa, Artificial Sequence
  Description of Artificial Sequence: Synthetic peptide
  Seed: GGMNQRPIL (TP53 R248Q)
GRMNQRPIM

SEQ ID NO: 20171 - protein, 9 aa, Artificial Sequence
  Description of Artificial Sequence: Synthetic peptide
  Seed: GGMNQRPIL (TP53 R248Q)
GRMNQRPIN

SEQ ID NO: 20172 - protein, 9 aa, Artificial Sequence
  Description of Artificial Sequence: Synthetic peptide
  Seed: GGMNQRPIL (TP53 R248Q)
GRMNQRPIP

SEQ ID NO: 20173 - protein, 9 aa, Artificial Sequence
  Description of Artificial Sequence: Synthetic peptide
  Seed: GGMNQRPIL (TP53 R248Q)
GRMNQRPIQ

SEQ ID NO: 20174 - protein, 9 aa, Artificial Sequence
  Description of Artificial Sequence: Synthetic peptide
  Seed: GGMNQRPIL (TP53 R248Q)
GRMNQRPIR

SEQ ID NO: 20175 - protein, 9 aa, Artificial Sequence
  Description of Artificial Sequence: Synthetic peptide
  Seed: GGMNQRPIL (TP53 R248Q)
GRMNQRPIS

SEQ ID NO: 20176 - protein, 9 aa, Artificial Sequence
  Description of Artificial Sequence: Synthetic peptide
  Seed: GGMNQRPIL (TP53 R248Q)
GRMNQRPIT

SEQ ID NO: 20177 - protein, 9 aa, Artificial Sequence
  Description of Artificial Sequence: Synthetic peptide
  Seed: GGMNQRPIL (TP53 R248Q)
GRMNQRPIV

SEQ ID NO: 20178 - protein, 9 aa, Artificial Sequence
  Description of Artificial Sequence: Synthetic peptide
  Seed: GGMNQRPIL (TP53 R248Q)
GRMNQRPIW

SEQ ID NO: 20179 - protein, 9 aa, Artificial Sequence
  Description of Artificial Sequence: Synthetic peptide
  Seed: GGMNQRPIL (TP53 R248Q)
GRMNQRPIY

SEQ ID NO: 20180 - protein, 10 aa, Artificial Sequence
  Description of Artificial Sequence: Synthetic peptide
  Seed: GMNQRPILTI (TP53 R248Q)
GRNQRPILTA

SEQ ID NO: 20181 - protein, 10 aa, Artificial Sequence
  Description of Artificial Sequence: Synthetic peptide
  Seed: GMNQRPILTI (TP53 R248Q)
GRNQRPILTC

SEQ ID NO: 20182 - protein, 10 aa, Artificial Sequence
  Description of Artificial Sequence: Synthetic peptide
  Seed: GMNQRPILTI (TP53 R248Q)
GRNQRPILTE

SEQ ID NO: 20183 - protein, 10 aa, Artificial Sequence
  Description of Artificial Sequence: Synthetic peptide
  Seed: GMNQRPILTI (TP53 R248Q)
GRNQRPILTF

SEQ ID NO: 20184 - protein, 10 aa, Artificial Sequence
  Description of Artificial Sequence: Synthetic peptide
  Seed: GMNQRPILTI (TP53 R248Q)
GRNQRPILTG

SEQ ID NO: 20185 - protein, 10 aa, Artificial Sequence
  Description of Artificial Sequence: Synthetic peptide
  Seed: GMNQRPILTI (TP53 R248Q)
GRNQRPILTH

SEQ ID NO: 20186 - protein, 10 aa, Artificial Sequence
  Description of Artificial Sequence: Synthetic peptide
  Seed: GMNQRPILTI (TP53 R248Q)
GRNQRPILTI

SEQ ID NO: 20187 - protein, 10 aa, Artificial Sequence
  Description of Artificial Sequence: Synthetic peptide
  Seed: GMNQRPILTI (TP53 R248Q)
GRNQRPILTK

SEQ ID NO: 20188 - protein, 10 aa, Artificial Sequence
  Description of Artificial Sequence: Synthetic peptide
  Seed: GMNQRPILTI (TP53 R248Q)
GRNQRPILTL

SEQ ID NO: 20189 - protein, 10 aa, Artificial Sequence
  Description of Artificial Sequence: Synthetic peptide
  Seed: GMNQRPILTI (TP53 R248Q)
GRNQRPILTM

SEQ ID NO: 20190 - protein, 10 aa, Artificial Sequence
  Description of Artificial Sequence: Synthetic peptide
  Seed: GMNQRPILTI (TP53 R248Q)
GRNQRPILTN

SEQ ID NO: 20191 - protein, 10 aa, Artificial Sequence
  Description of Artificial Sequence: Synthetic peptide
  Seed: GMNQRPILTI (TP53 R248Q)
GRNQRPILTQ

SEQ ID NO: 20192 - protein, 10 aa, Artificial Sequence
  Description of Artificial Sequence: Synthetic peptide
  Seed: GMNQRPILTI (TP53 R248Q)
GRNQRPILTR

SEQ ID NO: 20193 - protein, 10 aa, Artificial Sequence
  Description of Artificial Sequence: Synthetic peptide
  Seed: GMNQRPILTI (TP53 R248Q)
GRNQRPILTS

SEQ ID NO: 20194 - protein, 10 aa, Artificial Sequence
  Description of Artificial Sequence: Synthetic peptide
  Seed: GMNQRPILTI (TP53 R248Q)
GRNQRPILTT

SEQ ID NO: 20195 - protein, 10 aa, Artificial Sequence
  Description of Artificial Sequence: Synthetic peptide
  Seed: GMNQRPILTI (TP53 R248Q)
GRNQRPILTV

SEQ ID NO: 20196 - protein, 10 aa, Artificial Sequence
  Description of Artificial Sequence: Synthetic peptide
  Seed: GMNQRPILTI (TP53 R248Q)
GRNQRPILTW

SEQ ID NO: 20197 - protein, 10 aa, Artificial Sequence
  Description of Artificial Sequence: Synthetic peptide
  Seed: GMNQRPILTI (TP53 R248Q)
GRNQRPILTY

SEQ ID NO: 20198 - protein, 9 aa, Artificial Sequence
  Description of Artificial Sequence: Synthetic peptide
  Seed: GGMNQRPIL (TP53 R248Q)
GSMNQRPIL

SEQ ID NO: 20199 - protein, 10 aa, Artificial Sequence
  Description of Artificial Sequence: Synthetic peptide
  Seed: GMNQRPILTI (TP53 R248Q)
GSNQRPILTF

SEQ ID NO: 20200 - protein, 10 aa, Artificial Sequence
  Description of Artificial Sequence: Synthetic peptide
  Seed: GMNQRPILTI (TP53 R248Q)
GSNQRPILTL

SEQ ID NO: 20201 - protein, 9 aa, Artificial Sequence
  Description of Artificial Sequence: Synthetic peptide
  Seed: GGMNQRPIL (TP53 R248Q)
GTMNQRPIL

SEQ ID NO: 20202 - protein, 10 aa, Artificial Sequence
  Description of Artificial Sequence: Synthetic peptide
  Seed: GMNQRPILTI (TP53 R248Q)
GTNQRPILTF

SEQ ID NO: 20203 - protein, 10 aa, Artificial Sequence
  Description of Artificial Sequence: Synthetic peptide
  Seed: GMNQRPILTI (TP53 R248Q)
GTNQRPILTL

SEQ ID NO: 20204 - protein, 9 aa, Artificial Sequence
  Description of Artificial Sequence: Synthetic peptide
  Seed: GGMNQRPIL (TP53 R248Q)
GVMNQRPIL

SEQ ID NO: 20205 - protein, 10 aa, Artificial Sequence
  Description of Artificial Sequence: Synthetic peptide
  Seed: GMNQRPILTI (TP53 R248Q)
GVNQRPILTF

SEQ ID NO: 20206 - protein, 10 aa, Artificial Sequence
  Description of Artificial Sequence: Synthetic peptide
  Seed: GMNQRPILTI (TP53 R248Q)
GVNQRPILTI

SEQ ID NO: 20207 - protein, 10 aa, Artificial Sequence
  Description of Artificial Sequence: Synthetic peptide
  Seed: GMNQRPILTI (TP53 R248Q)
GVNQRPILTL

SEQ ID NO: 20208 - protein, 10 aa, Artificial Sequence
  Description of Artificial Sequence: Synthetic peptide
  Seed: GMNQRPILTI (TP53 R248Q)
GVNQRPILTV

SEQ ID NO: 20209 - protein, 9 aa, Artificial Sequence
  Description of Artificial Sequence: Synthetic peptide
  Seed: GGMNQRPIL (TP53 R248Q)
GYMNQRPIL

SEQ ID NO: 20210 - protein, 10 aa, Artificial Sequence
  Description of Artificial Sequence: Synthetic peptide
  Seed: MGGMNQRPIL (TP53 R248Q)
MAGMNQRPIL

SEQ ID NO: 20211 - protein, 9 aa, Artificial Sequence
  Description of Artificial Sequence: Synthetic peptide
  Seed: MNQRPILTI (TP53 R248Q)
MAQRPILTA

SEQ ID NO: 20212 - protein, 9 aa, Artificial Sequence
  Description of Artificial Sequence: Synthetic peptide
  Seed: MNQRPILTI (TP53 R248Q)
MAQRPILTC

SEQ ID NO: 20213 - protein, 9 aa, Artificial Sequence
  Description of Artificial Sequence: Synthetic peptide
  Seed: MNQRPILTI (TP53 R248Q)
MAQRPILTF

SEQ ID NO: 20214 - protein, 9 aa, Artificial Sequence
  Description of Artificial Sequence: Synthetic peptide
  Seed: MNQRPILTI (TP53 R248Q)
MAQRPILTH

SEQ ID NO: 20215 - protein, 9 aa, Artificial Sequence
  Description of Artificial Sequence: Synthetic peptide
  Seed: MNQRPILTI (TP53 R248Q)
MAQRPILTI

SEQ ID NO: 20216 - protein, 9 aa, Artificial Sequence
  Description of Artificial Sequence: Synthetic peptide
  Seed: MNQRPILTI (TP53 R248Q)
MAQRPILTK

SEQ ID NO: 20217 - protein, 9 aa, Artificial Sequence
  Description of Artificial Sequence: Synthetic peptide
  Seed: MNQRPILTI (TP53 R248Q)
MAQRPILTM

SEQ ID NO: 20218 - protein, 9 aa, Artificial Sequence
  Description of Artificial Sequence: Synthetic peptide
  Seed: MNQRPILTI (TP53 R248Q)
MAQRPILTP

SEQ ID NO: 20219 - protein, 9 aa, Artificial Sequence
  Description of Artificial Sequence: Synthetic peptide
  Seed: MNQRPILTI (TP53 R248Q)
MAQRPILTR

SEQ ID NO: 20220 - protein, 9 aa, Artificial Sequence
  Description of Artificial Sequence: Synthetic peptide
  Seed: MNQRPILTI (TP53 R248Q)
MAQRPILTT

SEQ ID NO: 20221 - protein, 9 aa, Artificial Sequence
  Description of Artificial Sequence: Synthetic peptide
  Seed: MNQRPILTI (TP53 R248Q)
MAQRPILTV

SEQ ID NO: 20222 - protein, 9 aa, Artificial Sequence
  Description of Artificial Sequence: Synthetic peptide
  Seed: MNQRPILTI (TP53 R248Q)
MAQRPILTW

SEQ ID NO: 20223 - protein, 9 aa, Artificial Sequence
  Description of Artificial Sequence: Synthetic peptide
  Seed: MNQRPILTI (TP53 R248Q)
MAQRPILTY

SEQ ID NO: 20224 - protein, 9 aa, Artificial Sequence
  Description of Artificial Sequence: Synthetic peptide
  Seed: MNQRPILTI (TP53 R248Q)
MCQRPILTF

SEQ ID NO: 20225 - protein, 9 aa, Artificial Sequence
  Description of Artificial Sequence: Synthetic peptide
  Seed: MNQRPILTI (TP53 R248Q)
MCQRPILTI

SEQ ID NO: 20226 - protein, 9 aa, Artificial Sequence
  Description of Artificial Sequence: Synthetic peptide
  Seed: MNQRPILTI (TP53 R248Q)
MCQRPILTK

SEQ ID NO: 20227 - protein, 9 aa, Artificial Sequence
  Description of Artificial Sequence: Synthetic peptide
  Seed: MNQRPILTI (TP53 R248Q)
MCQRPILTL

SEQ ID NO: 20228 - protein, 9 aa, Artificial Sequence
  Description of Artificial Sequence: Synthetic peptide
  Seed: MNQRPILTI (TP53 R248Q)
MCQRPILTM

SEQ ID NO: 20229 - protein, 9 aa, Artificial Sequence
  Description of Artificial Sequence: Synthetic peptide
  Seed: MNQRPILTI (TP53 R248Q)
MCQRPILTV

SEQ ID NO: 20230 - protein, 9 aa, Artificial Sequence
  Description of Artificial Sequence: Synthetic peptide
  Seed: MNQRPILTI (TP53 R248Q)
MCQRPILTW

SEQ ID NO: 20231 - protein, 9 aa, Artificial Sequence
  Description of Artificial Sequence: Synthetic peptide
  Seed: MNQRPILTI (TP53 R248Q)
MCQRPILTY

SEQ ID NO: 20232 - protein, 9 aa, Artificial Sequence
  Description of Artificial Sequence: Synthetic peptide
  Seed: MNQRPILTI (TP53 R248Q)
MDQRPILTF

SEQ ID NO: 20233 - protein, 9 aa, Artificial Sequence
  Description of Artificial Sequence: Synthetic peptide
  Seed: MNQRPILTI (TP53 R248Q)
MDQRPILTI

SEQ ID NO: 20234 - protein, 9 aa, Artificial Sequence
  Description of Artificial Sequence: Synthetic peptide
  Seed: MNQRPILTI (TP53 R248Q)
MDQRPILTK

SEQ ID NO: 20235 - protein, 9 aa, Artificial Sequence
  Description of Artificial Sequence: Synthetic peptide
  Seed: MNQRPILTI (TP53 R248Q)
MDQRPILTL

SEQ ID NO: 20236 - protein, 9 aa, Artificial Sequence
  Description of Artificial Sequence: Synthetic peptide
  Seed: MNQRPILTI (TP53 R248Q)
MDQRPILTM

SEQ ID NO: 20237 - protein, 9 aa, Artificial Sequence
  Description of Artificial Sequence: Synthetic peptide
  Seed: MNQRPILTI (TP53 R248Q)
MDQRPILTR

SEQ ID NO: 20238 - protein, 9 aa, Artificial Sequence
  Description of Artificial Sequence: Synthetic peptide
  Seed: MNQRPILTI (TP53 R248Q)
MDQRPILTV

SEQ ID NO: 20239 - protein, 9 aa, Artificial Sequence
  Description of Artificial Sequence: Synthetic peptide
  Seed: MNQRPILTI (TP53 R248Q)
MDQRPILTW

SEQ ID NO: 20240 - protein, 9 aa, Artificial Sequence
  Description of Artificial Sequence: Synthetic peptide
  Seed: MNQRPILTI (TP53 R248Q)
MDQRPILTY

SEQ ID NO: 20241 - protein, 9 aa, Artificial Sequence
  Description of Artificial Sequence: Synthetic peptide
  Seed: MNQRPILTI (TP53 R248Q)
MEQRPILTA

SEQ ID NO: 20242 - protein, 9 aa, Artificial Sequence
  Description of Artificial Sequence: Synthetic peptide
  Seed: MNQRPILTI (TP53 R248Q)
MEQRPILTC

SEQ ID NO: 20243 - protein, 9 aa, Artificial Sequence
  Description of Artificial Sequence: Synthetic peptide
  Seed: MNQRPILTI (TP53 R248Q)
MEQRPILTF

SEQ ID NO: 20244 - protein, 9 aa, Artificial Sequence
  Description of Artificial Sequence: Synthetic peptide
  Seed: MNQRPILTI (TP53 R248Q)
MEQRPILTI

SEQ ID NO: 20245 - protein, 9 aa, Artificial Sequence
  Description of Artificial Sequence: Synthetic peptide
  Seed: MNQRPILTI (TP53 R248Q)
MEQRPILTK

SEQ ID NO: 20246 - protein, 9 aa, Artificial Sequence
  Description of Artificial Sequence: Synthetic peptide
  Seed: MNQRPILTI (TP53 R248Q)
MEQRPILTL

SEQ ID NO: 20247 - protein, 9 aa, Artificial Sequence
  Description of Artificial Sequence: Synthetic peptide
  Seed: MNQRPILTI (TP53 R248Q)
MEQRPILTM

SEQ ID NO: 20248 - protein, 9 aa, Artificial Sequence
  Description of Artificial Sequence: Synthetic peptide
  Seed: MNQRPILTI (TP53 R248Q)
MEQRPILTR

SEQ ID NO: 20249 - protein, 9 aa, Artificial Sequence
  Description of Artificial Sequence: Synthetic peptide
  Seed: MNQRPILTI (TP53 R248Q)
MEQRPILTV

SEQ ID NO: 20250 - protein, 9 aa, Artificial Sequence
  Description of Artificial Sequence: Synthetic peptide
  Seed: MNQRPILTI (TP53 R248Q)
MEQRPILTW

SEQ ID NO: 20251 - protein, 9 aa, Artificial Sequence
  Description of Artificial Sequence: Synthetic peptide
  Seed: MNQRPILTI (TP53 R248Q)
MEQRPILTY

SEQ ID NO: 20252 - protein, 9 aa, Artificial Sequence
  Description of Artificial Sequence: Synthetic peptide
  Seed: MNQRPILTI (TP53 R248Q)
MFQRPILTF

SEQ ID NO: 20253 - protein, 9 aa, Artificial Sequence
  Description of Artificial Sequence: Synthetic peptide
  Seed: MNQRPILTI (TP53 R248Q)
MFQRPILTI

SEQ ID NO: 20254 - protein, 9 aa, Artificial Sequence
  Description of Artificial Sequence: Synthetic peptide
  Seed: MNQRPILTI (TP53 R248Q)
MFQRPILTL

SEQ ID NO: 20255 - protein, 9 aa, Artificial Sequence
  Description of Artificial Sequence: Synthetic peptide
  Seed: MNQRPILTI (TP53 R248Q)
MFQRPILTM

SEQ ID NO: 20256 - protein, 9 aa, Artificial Sequence
  Description of Artificial Sequence: Synthetic peptide
  Seed: MNQRPILTI (TP53 R248Q)
MFQRPILTV

SEQ ID NO: 20257 - protein, 9 aa, Artificial Sequence
  Description of Artificial Sequence: Synthetic peptide
  Seed: MNQRPILTI (TP53 R248Q)
MFQRPILTW

SEQ ID NO: 20258 - protein, 9 aa, Artificial Sequence
  Description of Artificial Sequence: Synthetic peptide
  Seed: MNQRPILTI (TP53 R248Q)
MFQRPILTY

SEQ ID NO: 20259 - protein, 10 aa, Artificial Sequence
  Description of Artificial Sequence: Synthetic peptide
  Seed: MGGMNQRPIL (TP53 R248Q)
MGGMNQRPIF

SEQ ID NO: 20260 - protein, 9 aa, Artificial Sequence
  Description of Artificial Sequence: Synthetic peptide
  Seed: MNQRPILTI (TP53 R248Q)
MGQRPILTA

SEQ ID NO: 20261 - protein, 9 aa, Artificial Sequence
  Description of Artificial Sequence: Synthetic peptide
  Seed: MNQRPILTI (TP53 R248Q)
MGQRPILTC

SEQ ID NO: 20262 - protein, 9 aa, Artificial Sequence
  Description of Artificial Sequence: Synthetic peptide
  Seed: MNQRPILTI (TP53 R248Q)
MGQRPILTF

SEQ ID NO: 20263 - protein, 9 aa, Artificial Sequence
  Description of Artificial Sequence: Synthetic peptide
  Seed: MNQRPILTI (TP53 R248Q)
MGQRPILTH

SEQ ID NO: 20264 - protein, 9 aa, Artificial Sequence
  Description of Artificial Sequence: Synthetic peptide
  Seed: MNQRPILTI (TP53 R248Q)
MGQRPILTI

SEQ ID NO: 20265 - protein, 9 aa, Artificial Sequence
  Description of Artificial Sequence: Synthetic peptide
  Seed: MNQRPILTI (TP53 R248Q)
MGQRPILTK

SEQ ID NO: 20266 - protein, 9 aa, Artificial Sequence
  Description of Artificial Sequence: Synthetic peptide
  Seed: MNQRPILTI (TP53 R248Q)
MGQRPILTL

SEQ ID NO: 20267 - protein, 9 aa, Artificial Sequence
  Description of Artificial Sequence: Synthetic peptide
  Seed: MNQRPILTI (TP53 R248Q)
MGQRPILTM

SEQ ID NO: 20268 - protein, 9 aa, Artificial Sequence
  Description of Artificial Sequence: Synthetic peptide
  Seed: MNQRPILTI (TP53 R248Q)
MGQRPILTR

SEQ ID NO: 20269 - protein, 9 aa, Artificial Sequence
  Description of Artificial Sequence: Synthetic peptide
  Seed: MNQRPILTI (TP53 R248Q)
MGQRPILTV

SEQ ID NO: 20270 - protein, 9 aa, Artificial Sequence
  Description of Artificial Sequence: Synthetic peptide
  Seed: MNQRPILTI (TP53 R248Q)
MGQRPILTW

SEQ ID NO: 20271 - protein, 9 aa, Artificial Sequence
  Description of Artificial Sequence: Synthetic peptide
  Seed: MNQRPILTI (TP53 R248Q)
MGQRPILTY

SEQ ID NO: 20272 - protein, 9 aa, Artificial Sequence
  Description of Artificial Sequence: Synthetic peptide
  Seed: MNQRPILTI (TP53 R248Q)
MHQRPILTF

SEQ ID NO: 20273 - protein, 9 aa, Artificial Sequence
  Description of Artificial Sequence: Synthetic peptide
  Seed: MNQRPILTI (TP53 R248Q)
MHQRPILTI

SEQ ID NO: 20274 - protein, 9 aa, Artificial Sequence
  Description of Artificial Sequence: Synthetic peptide
  Seed: MNQRPILTI (TP53 R248Q)
MHQRPILTK

SEQ ID NO: 20275 - protein, 9 aa, Artificial Sequence
  Description of Artificial Sequence: Synthetic peptide
  Seed: MNQRPILTI (TP53 R248Q)
MHQRPILTL

SEQ ID NO: 20276 - protein, 9 aa, Artificial Sequence
  Description of Artificial Sequence: Synthetic peptide
  Seed: MNQRPILTI (TP53 R248Q)
MHQRPILTM

SEQ ID NO: 20277 - protein, 9 aa, Artificial Sequence
  Description of Artificial Sequence: Synthetic peptide
  Seed: MNQRPILTI (TP53 R248Q)
MHQRPILTV

SEQ ID NO: 20278 - protein, 9 aa, Artificial Sequence
  Description of Artificial Sequence: Synthetic peptide
  Seed: MNQRPILTI (TP53 R248Q)
MHQRPILTW

SEQ ID NO: 20279 - protein, 9 aa, Artificial Sequence
  Description of Artificial Sequence: Synthetic peptide
  Seed: MNQRPILTI (TP53 R248Q)
MHQRPILTY

SEQ ID NO: 20280 - protein, 10 aa, Artificial Sequence
  Description of Artificial Sequence: Synthetic peptide
  Seed: MGGMNQRPIL (TP53 R248Q)
MIGMNQRPIL

SEQ ID NO: 20281 - protein, 9 aa, Artificial Sequence
  Description of Artificial Sequence: Synthetic peptide
  Seed: MNQRPILTI (TP53 R248Q)
MIQRPILTA

SEQ ID NO: 20282 - protein, 9 aa, Artificial Sequence
  Description of Artificial Sequence: Synthetic peptide
  Seed: MNQRPILTI (TP53 R248Q)
MIQRPILTC

SEQ ID NO: 20283 - protein, 9 aa, Artificial Sequence
  Description of Artificial Sequence: Synthetic peptide
  Seed: MNQRPILTI (TP53 R248Q)
MIQRPILTF

SEQ ID NO: 20284 - protein, 9 aa, Artificial Sequence
  Description of Artificial Sequence: Synthetic peptide
  Seed: MNQRPILTI (TP53 R248Q)
MIQRPILTI

SEQ ID NO: 20285 - protein, 9 aa, Artificial Sequence
  Description of Artificial Sequence: Synthetic peptide
  Seed: MNQRPILTI (TP53 R248Q)
MIQRPILTK

SEQ ID NO: 20286 - protein, 9 aa, Artificial Sequence
  Description of Artificial Sequence: Synthetic peptide
  Seed: MNQRPILTI (TP53 R248Q)
MIQRPILTL

SEQ ID NO: 20287 - protein, 9 aa, Artificial Sequence
  Description of Artificial Sequence: Synthetic peptide
  Seed: MNQRPILTI (TP53 R248Q)
MIQRPILTM

SEQ ID NO: 20288 - protein, 9 aa, Artificial Sequence
  Description of Artificial Sequence: Synthetic peptide
  Seed: MNQRPILTI (TP53 R248Q)
MIQRPILTR

SEQ ID NO: 20289 - protein, 9 aa, Artificial Sequence
  Description of Artificial Sequence: Synthetic peptide
  Seed: MNQRPILTI (TP53 R248Q)
MIQRPILTV

SEQ ID NO: 20290 - protein, 9 aa, Artificial Sequence
  Description of Artificial Sequence: Synthetic peptide
  Seed: MNQRPILTI (TP53 R248Q)
MIQRPILTW

SEQ ID NO: 20291 - protein, 9 aa, Artificial Sequence
  Description of Artificial Sequence: Synthetic peptide
  Seed: MNQRPILTI (TP53 R248Q)
MIQRPILTY

SEQ ID NO: 20292 - protein, 9 aa, Artificial Sequence
  Description of Artificial Sequence: Synthetic peptide
  Seed: MNQRPILTI (TP53 R248Q)
MKQRPILTF

SEQ ID NO: 20293 - protein, 9 aa, Artificial Sequence
  Description of Artificial Sequence: Synthetic peptide
  Seed: MNQRPILTI (TP53 R248Q)
MKQRPILTI

SEQ ID NO: 20294 - protein, 9 aa, Artificial Sequence
  Description of Artificial Sequence: Synthetic peptide
  Seed: MNQRPILTI (TP53 R248Q)
MKQRPILTK

SEQ ID NO: 20295 - protein, 9 aa, Artificial Sequence
  Description of Artificial Sequence: Synthetic peptide
  Seed: MNQRPILTI (TP53 R248Q)
MKQRPILTL

SEQ ID NO: 20296 - protein, 9 aa, Artificial Sequence
  Description of Artificial Sequence: Synthetic peptide
  Seed: MNQRPILTI (TP53 R248Q)
MKQRPILTM

SEQ ID NO: 20297 - protein, 9 aa, Artificial Sequence
  Description of Artificial Sequence: Synthetic peptide
  Seed: MNQRPILTI (TP53 R248Q)
MKQRPILTR

SEQ ID NO: 20298 - protein, 9 aa, Artificial Sequence
  Description of Artificial Sequence: Synthetic peptide
  Seed: MNQRPILTI (TP53 R248Q)
MKQRPILTV

SEQ ID NO: 20299 - protein, 9 aa, Artificial Sequence
  Description of Artificial Sequence: Synthetic peptide
  Seed: MNQRPILTI (TP53 R248Q)
MKQRPILTW

SEQ ID NO: 20300 - protein, 9 aa, Artificial Sequence
  Description of Artificial Sequence: Synthetic peptide
  Seed: MNQRPILTI (TP53 R248Q)
MKQRPILTY

SEQ ID NO: 20301 - protein, 10 aa, Artificial Sequence
  Description of Artificial Sequence: Synthetic peptide
  Seed: MGGMNQRPIL (TP53 R248Q)
MLGMNQRPIL

SEQ ID NO: 20302 - protein, 9 aa, Artificial Sequence
  Description of Artificial Sequence: Synthetic peptide
  Seed: MNQRPILTI (TP53 R248Q)
MLQRPILTA

SEQ ID NO: 20303 - protein, 9 aa, Artificial Sequence
  Description of Artificial Sequence: Synthetic peptide
  Seed: MNQRPILTI (TP53 R248Q)
MLQRPILTC

SEQ ID NO: 20304 - protein, 9 aa, Artificial Sequence
  Description of Artificial Sequence: Synthetic peptide
  Seed: MNQRPILTI (TP53 R248Q)
MLQRPILTF

SEQ ID NO: 20305 - protein, 9 aa, Artificial Sequence
  Description of Artificial Sequence: Synthetic peptide
  Seed: MNQRPILTI (TP53 R248Q)
MLQRPILTI

SEQ ID NO: 20306 - protein, 9 aa, Artificial Sequence
  Description of Artificial Sequence: Synthetic peptide
  Seed: MNQRPILTI (TP53 R248Q)
MLQRPILTK

SEQ ID NO: 20307 - protein, 9 aa, Artificial Sequence
  Description of Artificial Sequence: Synthetic peptide
  Seed: MNQRPILTI (TP53 R248Q)
MLQRPILTL

SEQ ID NO: 20308 - protein, 9 aa, Artificial Sequence
  Description of Artificial Sequence: Synthetic peptide
  Seed: MNQRPILTI (TP53 R248Q)
MLQRPILTM

SEQ ID NO: 20309 - protein, 9 aa, Artificial Sequence
  Description of Artificial Sequence: Synthetic peptide
  Seed: MNQRPILTI (TP53 R248Q)
MLQRPILTR

SEQ ID NO: 20310 - protein, 9 aa, Artificial Sequence
  Description of Artificial Sequence: Synthetic peptide
  Seed: MNQRPILTI (TP53 R248Q)
MLQRPILTV

SEQ ID NO: 20311 - protein, 9 aa, Artificial Sequence
  Description of Artificial Sequence: Synthetic peptide
  Seed: MNQRPILTI (TP53 R248Q)
MLQRPILTW

SEQ ID NO: 20312 - protein, 9 aa, Artificial Sequence
  Description of Artificial Sequence: Synthetic peptide
  Seed: MNQRPILTI (TP53 R248Q)
MLQRPILTY

SEQ ID NO: 20313 - protein, 10 aa, Artificial Sequence
  Description of Artificial Sequence: Synthetic peptide
  Seed: MGGMNQRPIL (TP53 R248Q)
MMGMNQRPIL

SEQ ID NO: 20314 - protein, 9 aa, Artificial Sequence
  Description of Artificial Sequence: Synthetic peptide
  Seed: MNQRPILTI (TP53 R248Q)
MMQRPILTA

SEQ ID NO: 20315 - protein, 9 aa, Artificial Sequence
  Description of Artificial Sequence: Synthetic peptide
  Seed: MNQRPILTI (TP53 R248Q)
MMQRPILTC

SEQ ID NO: 20316 - protein, 9 aa, Artificial Sequence
  Description of Artificial Sequence: Synthetic peptide
  Seed: MNQRPILTI (TP53 R248Q)
MMQRPILTF

SEQ ID NO: 20317 - protein, 9 aa, Artificial Sequence
  Description of Artificial Sequence: Synthetic peptide
  Seed: MNQRPILTI (TP53 R248Q)
MMQRPILTI

SEQ ID NO: 20318 - protein, 9 aa, Artificial Sequence
  Description of Artificial Sequence: Synthetic peptide
  Seed: MNQRPILTI (TP53 R248Q)
MMQRPILTK

SEQ ID NO: 20319 - protein, 9 aa, Artificial Sequence
  Description of Artificial Sequence: Synthetic peptide
  Seed: MNQRPILTI (TP53 R248Q)
MMQRPILTL

SEQ ID NO: 20320 - protein, 9 aa, Artificial Sequence
  Description of Artificial Sequence: Synthetic peptide
  Seed: MNQRPILTI (TP53 R248Q)
MMQRPILTM

SEQ ID NO: 20321 - protein, 9 aa, Artificial Sequence
  Description of Artificial Sequence: Synthetic peptide
  Seed: MNQRPILTI (TP53 R248Q)
MMQRPILTR

SEQ ID NO: 20322 - protein, 9 aa, Artificial Sequence
  Description of Artificial Sequence: Synthetic peptide
  Seed: MNQRPILTI (TP53 R248Q)
MMQRPILTV

SEQ ID NO: 20323 - protein, 9 aa, Artificial Sequence
  Description of Artificial Sequence: Synthetic peptide
  Seed: MNQRPILTI (TP53 R248Q)
MMQRPILTW

SEQ ID NO: 20324 - protein, 9 aa, Artificial Sequence
  Description of Artificial Sequence: Synthetic peptide
  Seed: MNQRPILTI (TP53 R248Q)
MMQRPILTY

SEQ ID NO: 20325 - protein, 10 aa, Artificial Sequence
  Description of Artificial Sequence: Synthetic peptide
  Seed: MGGMNQRPIL (TP53 R248Q)
MNGMNQRPIL

SEQ ID NO: 20326 - protein, 9 aa, Artificial Sequence
  Description of Artificial Sequence: Synthetic peptide
  Seed: MNQRPILTI (TP53 R248Q)
MNQRPILTF

SEQ ID NO: 20327 - protein, 9 aa, Artificial Sequence
  Description of Artificial Sequence: Synthetic peptide
  Seed: MNQRPILTI (TP53 R248Q)
MNQRPILTK

SEQ ID NO: 20328 - protein, 9 aa, Artificial Sequence
  Description of Artificial Sequence: Synthetic peptide
  Seed: MNQRPILTI (TP53 R248Q)
MNQRPILTL

SEQ ID NO: 20329 - protein, 9 aa, Artificial Sequence
  Description of Artificial Sequence: Synthetic peptide
  Seed: MNQRPILTI (TP53 R248Q)
MNQRPILTM

SEQ ID NO: 20330 - protein, 9 aa, Artificial Sequence
  Description of Artificial Sequence: Synthetic peptide
  Seed: MNQRPILTI (TP53 R248Q)
MNQRPILTR

SEQ ID NO: 20331 - protein, 9 aa, Artificial Sequence
  Description of Artificial Sequence: Synthetic peptide
  Seed: MNQRPILTI (TP53 R248Q)
MNQRPILTV

SEQ ID NO: 20332 - protein, 9 aa, Artificial Sequence
  Description of Artificial Sequence: Synthetic peptide
  Seed: MNQRPILTI (TP53 R248Q)
MNQRPILTW

SEQ ID NO: 20333 - protein, 9 aa, Artificial Sequence
  Description of Artificial Sequence: Synthetic peptide
  Seed: MNQRPILTI (TP53 R248Q)
MNQRPILTY

SEQ ID NO: 20334 - protein, 9 aa, Artificial Sequence
  Description of Artificial Sequence: Synthetic peptide
  Seed: MNQRPILTI (TP53 R248Q)
MPQRPILTA

SEQ ID NO: 20335 - protein, 9 aa, Artificial Sequence
  Description of Artificial Sequence: Synthetic peptide
  Seed: MNQRPILTI (TP53 R248Q)
MPQRPILTF

SEQ ID NO: 20336 - protein, 9 aa, Artificial Sequence
  Description of Artificial Sequence: Synthetic peptide
  Seed: MNQRPILTI (TP53 R248Q)
MPQRPILTI

SEQ ID NO: 20337 - protein, 9 aa, Artificial Sequence
  Description of Artificial Sequence: Synthetic peptide
  Seed: MNQRPILTI (TP53 R248Q)
MPQRPILTK

SEQ ID NO: 20338 - protein, 9 aa, Artificial Sequence
  Description of Artificial Sequence: Synthetic peptide
  Seed: MNQRPILTI (TP53 R248Q)
MPQRPILTL

SEQ ID NO: 20339 - protein, 9 aa, Artificial Sequence
  Description of Artificial Sequence: Synthetic peptide
  Seed: MNQRPILTI (TP53 R248Q)
MPQRPILTM

SEQ ID NO: 20340 - protein, 9 aa, Artificial Sequence
  Description of Artificial Sequence: Synthetic peptide
  Seed: MNQRPILTI (TP53 R248Q)
MPQRPILTV

SEQ ID NO: 20341 - protein, 9 aa, Artificial Sequence
  Description of Artificial Sequence: Synthetic peptide
  Seed: MNQRPILTI (TP53 R248Q)
MPQRPILTW

SEQ ID NO: 20342 - protein, 9 aa, Artificial Sequence
  Description of Artificial Sequence: Synthetic peptide
  Seed: MNQRPILTI (TP53 R248Q)
MPQRPILTY

SEQ ID NO: 20343 - protein, 10 aa, Artificial Sequence
  Description of Artificial Sequence: Synthetic peptide
  Seed: MGGMNQRPIL (TP53 R248Q)
MQGMNQRPIL

SEQ ID NO: 20344 - protein, 9 aa, Artificial Sequence
  Description of Artificial Sequence: Synthetic peptide
  Seed: MNQRPILTI (TP53 R248Q)
MQQRPILTA

SEQ ID NO: 20345 - protein, 9 aa, Artificial Sequence
  Description of Artificial Sequence: Synthetic peptide
  Seed: MNQRPILTI (TP53 R248Q)
MQQRPILTC

SEQ ID NO: 20346 - protein, 9 aa, Artificial Sequence
  Description of Artificial Sequence: Synthetic peptide
  Seed: MNQRPILTI (TP53 R248Q)
MQQRPILTF

SEQ ID NO: 20347 - protein, 9 aa, Artificial Sequence
  Description of Artificial Sequence: Synthetic peptide
  Seed: MNQRPILTI (TP53 R248Q)
MQQRPILTH

SEQ ID NO: 20348 - protein, 9 aa, Artificial Sequence
  Description of Artificial Sequence: Synthetic peptide
  Seed: MNQRPILTI (TP53 R248Q)
MQQRPILTI

SEQ ID NO: 20349 - protein, 9 aa, Artificial Sequence
  Description of Artificial Sequence: Synthetic peptide
  Seed: MNQRPILTI (TP53 R248Q)
MQQRPILTK

SEQ ID NO: 20350 - protein, 9 aa, Artificial Sequence
  Description of Artificial Sequence: Synthetic peptide
  Seed: MNQRPILTI (TP53 R248Q)
MQQRPILTM

SEQ ID NO: 20351 - protein, 9 aa, Artificial Sequence
  Description of Artificial Sequence: Synthetic peptide
  Seed: MNQRPILTI (TP53 R248Q)
MQQRPILTP

SEQ ID NO: 20352 - protein, 9 aa, Artificial Sequence
  Description of Artificial Sequence: Synthetic peptide
  Seed: MNQRPILTI (TP53 R248Q)
MQQRPILTR

SEQ ID NO: 20353 - protein, 9 aa, Artificial Sequence
  Description of Artificial Sequence: Synthetic peptide
  Seed: MNQRPILTI (TP53 R248Q)
MQQRPILTT

SEQ ID NO: 20354 - protein, 9 aa, Artificial Sequence
  Description of Artificial Sequence: Synthetic peptide
  Seed: MNQRPILTI (TP53 R248Q)
MQQRPILTW

SEQ ID NO: 20355 - protein, 9 aa, Artificial Sequence
  Description of Artificial Sequence: Synthetic peptide
  Seed: MNQRPILTI (TP53 R248Q)
MQQRPILTY

SEQ ID NO: 20356 - protein, 10 aa, Artificial Sequence
  Description of Artificial Sequence: Synthetic peptide
  Seed: MGGMNQRPIL (TP53 R248Q)
MRGMNQRPIF

SEQ ID NO: 20357 - protein, 10 aa, Artificial Sequence
  Description of Artificial Sequence: Synthetic peptide
  Seed: MGGMNQRPIL (TP53 R248Q)
MRGMNQRPII

SEQ ID NO: 20358 - protein, 10 aa, Artificial Sequence
  Description of Artificial Sequence: Synthetic peptide
  Seed: MGGMNQRPIL (TP53 R248Q)
MRGMNQRPIK

SEQ ID NO: 20359 - protein, 10 aa, Artificial Sequence
  Description of Artificial Sequence: Synthetic peptide
  Seed: MGGMNQRPIL (TP53 R248Q)
MRGMNQRPIL

SEQ ID NO: 20360 - protein, 10 aa, Artificial Sequence
  Description of Artificial Sequence: Synthetic peptide
  Seed: MGGMNQRPIL (TP53 R248Q)
MRGMNQRPIM

SEQ ID NO: 20361 - protein, 10 aa, Artificial Sequence
  Description of Artificial Sequence: Synthetic peptide
  Seed: MGGMNQRPIL (TP53 R248Q)
MRGMNQRPIR

SEQ ID NO: 20362 - protein, 10 aa, Artificial Sequence
  Description of Artificial Sequence: Synthetic peptide
  Seed: MGGMNQRPIL (TP53 R248Q)
MRGMNQRPIY

SEQ ID NO: 20363 - protein, 9 aa, Artificial Sequence
  Description of Artificial Sequence: Synthetic peptide
  Seed: MNQRPILTI (TP53 R248Q)
MRQRPILTA

SEQ ID NO: 20364 - protein, 9 aa, Artificial Sequence
  Description of Artificial Sequence: Synthetic peptide
  Seed: MNQRPILTI (TP53 R248Q)
MRQRPILTC

SEQ ID NO: 20365 - protein, 9 aa, Artificial Sequence
  Description of Artificial Sequence: Synthetic peptide
  Seed: MNQRPILTI (TP53 R248Q)
MRQRPILTE

SEQ ID NO: 20366 - protein, 9 aa, Artificial Sequence
  Description of Artificial Sequence: Synthetic peptide
  Seed: MNQRPILTI (TP53 R248Q)
MRQRPILTF

SEQ ID NO: 20367 - protein, 9 aa, Artificial Sequence
  Description of Artificial Sequence: Synthetic peptide
  Seed: MNQRPILTI (TP53 R248Q)
MRQRPILTG

SEQ ID NO: 20368 - protein, 9 aa, Artificial Sequence
  Description of Artificial Sequence: Synthetic peptide
  Seed: MNQRPILTI (TP53 R248Q)
MRQRPILTH

SEQ ID NO: 20369 - protein, 9 aa, Artificial Sequence
  Description of Artificial Sequence: Synthetic peptide
  Seed: MNQRPILTI (TP53 R248Q)
MRQRPILTI

SEQ ID NO: 20370 - protein, 9 aa, Artificial Sequence
  Description of Artificial Sequence: Synthetic peptide
  Seed: MNQRPILTI (TP53 R248Q)
MRQRPILTK

SEQ ID NO: 20371 - protein, 9 aa, Artificial Sequence
  Description of Artificial Sequence: Synthetic peptide
  Seed: MNQRPILTI (TP53 R248Q)
MRQRPILTM

SEQ ID NO: 20372 - protein, 9 aa, Artificial Sequence
  Description of Artificial Sequence: Synthetic peptide
  Seed: MNQRPILTI (TP53 R248Q)
MRQRPILTN

SEQ ID NO: 20373 - protein, 9 aa, Artificial Sequence
  Description of Artificial Sequence: Synthetic peptide
  Seed: MNQRPILTI (TP53 R248Q)
MRQRPILTP

SEQ ID NO: 20374 - protein, 9 aa, Artificial Sequence
  Description of Artificial Sequence: Synthetic peptide
  Seed: MNQRPILTI (TP53 R248Q)
MRQRPILTQ

SEQ ID NO: 20375 - protein, 9 aa, Artificial Sequence
  Description of Artificial Sequence: Synthetic peptide
  Seed: MNQRPILTI (TP53 R248Q)
MRQRPILTR

SEQ ID NO: 20376 - protein, 9 aa, Artificial Sequence
  Description of Artificial Sequence: Synthetic peptide
  Seed: MNQRPILTI (TP53 R248Q)
MRQRPILTS

SEQ ID NO: 20377 - protein, 9 aa, Artificial Sequence
  Description of Artificial Sequence: Synthetic peptide
  Seed: MNQRPILTI (TP53 R248Q)
MRQRPILTT

SEQ ID NO: 20378 - protein, 9 aa, Artificial Sequence
  Description of Artificial Sequence: Synthetic peptide
  Seed: MNQRPILTI (TP53 R248Q)
MRQRPILTV

SEQ ID NO: 20379 - protein, 9 aa, Artificial Sequence
  Description of Artificial Sequence: Synthetic peptide
  Seed: MNQRPILTI (TP53 R248Q)
MRQRPILTW

SEQ ID NO: 20380 - protein, 9 aa, Artificial Sequence
  Description of Artificial Sequence: Synthetic peptide
  Seed: MNQRPILTI (TP53 R248Q)
MRQRPILTY

SEQ ID NO: 20381 - protein, 10 aa, Artificial Sequence
  Description of Artificial Sequence: Synthetic peptide
  Seed: MGGMNQRPIL (TP53 R248Q)
MSGMNQRPIL

SEQ ID NO: 20382 - protein, 9 aa, Artificial Sequence
  Description of Artificial Sequence: Synthetic peptide
  Seed: MNQRPILTI (TP53 R248Q)
MSQRPILTA

SEQ ID NO: 20383 - protein, 9 aa, Artificial Sequence
  Description of Artificial Sequence: Synthetic peptide
  Seed: MNQRPILTI (TP53 R248Q)
MSQRPILTC

SEQ ID NO: 20384 - protein, 9 aa, Artificial Sequence
  Description of Artificial Sequence: Synthetic peptide
  Seed: MNQRPILTI (TP53 R248Q)
MSQRPILTF

SEQ ID NO: 20385 - protein, 9 aa, Artificial Sequence
  Description of Artificial Sequence: Synthetic peptide
  Seed: MNQRPILTI (TP53 R248Q)
MSQRPILTH

SEQ ID NO: 20386 - protein, 9 aa, Artificial Sequence
  Description of Artificial Sequence: Synthetic peptide
  Seed: MNQRPILTI (TP53 R248Q)
MSQRPILTI

SEQ ID NO: 20387 - protein, 9 aa, Artificial Sequence
  Description of Artificial Sequence: Synthetic peptide
  Seed: MNQRPILTI (TP53 R248Q)
MSQRPILTK

SEQ ID NO: 20388 - protein, 9 aa, Artificial Sequence
  Description of Artificial Sequence: Synthetic peptide
  Seed: MNQRPILTI (TP53 R248Q)
MSQRPILTL

SEQ ID NO: 20389 - protein, 9 aa, Artificial Sequence
  Description of Artificial Sequence: Synthetic peptide
  Seed: MNQRPILTI (TP53 R248Q)
MSQRPILTM

SEQ ID NO: 20390 - protein, 9 aa, Artificial Sequence
  Description of Artificial Sequence: Synthetic peptide
  Seed: MNQRPILTI (TP53 R248Q)
MSQRPILTR

SEQ ID NO: 20391 - protein, 9 aa, Artificial Sequence
  Description of Artificial Sequence: Synthetic peptide
  Seed: MNQRPILTI (TP53 R248Q)
MSQRPILTT

SEQ ID NO: 20392 - protein, 9 aa, Artificial Sequence
  Description of Artificial Sequence: Synthetic peptide
  Seed: MNQRPILTI (TP53 R248Q)
MSQRPILTV

SEQ ID NO: 20393 - protein, 9 aa, Artificial Sequence
  Description of Artificial Sequence: Synthetic peptide
  Seed: MNQRPILTI (TP53 R248Q)
MSQRPILTW

SEQ ID NO: 20394 - protein, 9 aa, Artificial Sequence
  Description of Artificial Sequence: Synthetic peptide
  Seed: MNQRPILTI (TP53 R248Q)
MSQRPILTY

SEQ ID NO: 20395 - protein, 10 aa, Artificial Sequence
  Description of Artificial Sequence: Synthetic peptide
  Seed: MGGMNQRPIL (TP53 R248Q)
MTGMNQRPIF

SEQ ID NO: 20396 - protein, 10 aa, Artificial Sequence
  Description of Artificial Sequence: Synthetic peptide
  Seed: MGGMNQRPIL (TP53 R248Q)
MTGMNQRPIL

SEQ ID NO: 20397 - protein, 9 aa, Artificial Sequence
  Description of Artificial Sequence: Synthetic peptide
  Seed: MNQRPILTI (TP53 R248Q)
MTQRPILTA

SEQ ID NO: 20398 - protein, 9 aa, Artificial Sequence
  Description of Artificial Sequence: Synthetic peptide
  Seed: MNQRPILTI (TP53 R248Q)
MTQRPILTC

SEQ ID NO: 20399 - protein, 9 aa, Artificial Sequence
  Description of Artificial Sequence: Synthetic peptide
  Seed: MNQRPILTI (TP53 R248Q)
MTQRPILTF

SEQ ID NO: 20400 - protein, 9 aa, Artificial Sequence
  Description of Artificial Sequence: Synthetic peptide
  Seed: MNQRPILTI (TP53 R248Q)
MTQRPILTH

SEQ ID NO: 20401 - protein, 9 aa, Artificial Sequence
  Description of Artificial Sequence: Synthetic peptide
  Seed: MNQRPILTI (TP53 R248Q)
MTQRPILTI

SEQ ID NO: 20402 - protein, 9 aa, Artificial Sequence
  Description of Artificial Sequence: Synthetic peptide
  Seed: MNQRPILTI (TP53 R248Q)
MTQRPILTK

SEQ ID NO: 20403 - protein, 9 aa, Artificial Sequence
  Description of Artificial Sequence: Synthetic peptide
  Seed: MNQRPILTI (TP53 R248Q)
MTQRPILTL

SEQ ID NO: 20404 - protein, 9 aa, Artificial Sequence
  Description of Artificial Sequence: Synthetic peptide
  Seed: MNQRPILTI (TP53 R248Q)
MTQRPILTM

SEQ ID NO: 20405 - protein, 9 aa, Artificial Sequence
  Description of Artificial Sequence: Synthetic peptide
  Seed: MNQRPILTI (TP53 R248Q)
MTQRPILTR

SEQ ID NO: 20406 - protein, 9 aa, Artificial Sequence
  Description of Artificial Sequence: Synthetic peptide
  Seed: MNQRPILTI (TP53 R248Q)
MTQRPILTT

SEQ ID NO: 20407 - protein, 9 aa, Artificial Sequence
  Description of Artificial Sequence: Synthetic peptide
  Seed: MNQRPILTI (TP53 R248Q)
MTQRPILTV

SEQ ID NO: 20408 - protein, 9 aa, Artificial Sequence
  Description of Artificial Sequence: Synthetic peptide
  Seed: MNQRPILTI (TP53 R248Q)
MTQRPILTW

SEQ ID NO: 20409 - protein, 9 aa, Artificial Sequence
  Description of Artificial Sequence: Synthetic peptide
  Seed: MNQRPILTI (TP53 R248Q)
MTQRPILTY

SEQ ID NO: 20410 - protein, 10 aa, Artificial Sequence
  Description of Artificial Sequence: Synthetic peptide
  Seed: MGGMNQRPIL (TP53 R248Q)
MVGMNQRPIL

SEQ ID NO: 20411 - protein, 9 aa, Artificial Sequence
  Description of Artificial Sequence: Synthetic peptide
  Seed: MNQRPILTI (TP53 R248Q)
MVQRPILTA

SEQ ID NO: 20412 - protein, 9 aa, Artificial Sequence
  Description of Artificial Sequence: Synthetic peptide
  Seed: MNQRPILTI (TP53 R248Q)
MVQRPILTC

SEQ ID NO: 20413 - protein, 9 aa, Artificial Sequence
  Description of Artificial Sequence: Synthetic peptide
  Seed: MNQRPILTI (TP53 R248Q)
MVQRPILTF

SEQ ID NO: 20414 - protein, 9 aa, Artificial Sequence
  Description of Artificial Sequence: Synthetic peptide
  Seed: MNQRPILTI (TP53 R248Q)
MVQRPILTH

SEQ ID NO: 20415 - protein, 9 aa, Artificial Sequence
  Description of Artificial Sequence: Synthetic peptide
  Seed: MNQRPILTI (TP53 R248Q)
MVQRPILTI

SEQ ID NO: 20416 - protein, 9 aa, Artificial Sequence
  Description of Artificial Sequence: Synthetic peptide
  Seed: MNQRPILTI (TP53 R248Q)
MVQRPILTK

SEQ ID NO: 20417 - protein, 9 aa, Artificial Sequence
  Description of Artificial Sequence: Synthetic peptide
  Seed: MNQRPILTI (TP53 R248Q)
MVQRPILTL

SEQ ID NO: 20418 - protein, 9 aa, Artificial Sequence
  Description of Artificial Sequence: Synthetic peptide
  Seed: MNQRPILTI (TP53 R248Q)
MVQRPILTM

SEQ ID NO: 20419 - protein, 9 aa, Artificial Sequence
  Description of Artificial Sequence: Synthetic peptide
  Seed: MNQRPILTI (TP53 R248Q)
MVQRPILTR

SEQ ID NO: 20420 - protein, 9 aa, Artificial Sequence
  Description of Artificial Sequence: Synthetic peptide
  Seed: MNQRPILTI (TP53 R248Q)
MVQRPILTV

SEQ ID NO: 20421 - protein, 9 aa, Artificial Sequence
  Description of Artificial Sequence: Synthetic peptide
  Seed: MNQRPILTI (TP53 R248Q)
MVQRPILTW

SEQ ID NO: 20422 - protein, 9 aa, Artificial Sequence
  Description of Artificial Sequence: Synthetic peptide
  Seed: MNQRPILTI (TP53 R248Q)
MVQRPILTY

SEQ ID NO: 20423 - protein, 9 aa, Artificial Sequence
  Description of Artificial Sequence: Synthetic peptide
  Seed: MNQRPILTI (TP53 R248Q)
MWQRPILTF

SEQ ID NO: 20424 - protein, 9 aa, Artificial Sequence
  Description of Artificial Sequence: Synthetic peptide
  Seed: MNQRPILTI (TP53 R248Q)
MWQRPILTI

SEQ ID NO: 20425 - protein, 9 aa, Artificial Sequence
  Description of Artificial Sequence: Synthetic peptide
  Seed: MNQRPILTI (TP53 R248Q)
MWQRPILTL

SEQ ID NO: 20426 - protein, 9 aa, Artificial Sequence
  Description of Artificial Sequence: Synthetic peptide
  Seed: MNQRPILTI (TP53 R248Q)
MWQRPILTM

SEQ ID NO: 20427 - protein, 9 aa, Artificial Sequence
  Description of Artificial Sequence: Synthetic peptide
  Seed: MNQRPILTI (TP53 R248Q)
MWQRPILTV

SEQ ID NO: 20428 - protein, 9 aa, Artificial Sequence
  Description of Artificial Sequence: Synthetic peptide
  Seed: MNQRPILTI (TP53 R248Q)
MWQRPILTW

SEQ ID NO: 20429 - protein, 9 aa, Artificial Sequence
  Description of Artificial Sequence: Synthetic peptide
  Seed: MNQRPILTI (TP53 R248Q)
MWQRPILTY

SEQ ID NO: 20430 - protein, 9 aa, Artificial Sequence
  Description of Artificial Sequence: Synthetic peptide
  Seed: MNQRPILTI (TP53 R248Q)
MYQRPILTC

SEQ ID NO: 20431 - protein, 9 aa, Artificial Sequence
  Description of Artificial Sequence: Synthetic peptide
  Seed: MNQRPILTI (TP53 R248Q)
MYQRPILTF

SEQ ID NO: 20432 - protein, 9 aa, Artificial Sequence
  Description of Artificial Sequence: Synthetic peptide
  Seed: MNQRPILTI (TP53 R248Q)
MYQRPILTI

SEQ ID NO: 20433 - protein, 9 aa, Artificial Sequence
  Description of Artificial Sequence: Synthetic peptide
  Seed: MNQRPILTI (TP53 R248Q)
MYQRPILTL

SEQ ID NO: 20434 - protein, 9 aa, Artificial Sequence
  Description of Artificial Sequence: Synthetic peptide
  Seed: MNQRPILTI (TP53 R248Q)
MYQRPILTM

SEQ ID NO: 20435 - protein, 9 aa, Artificial Sequence
  Description of Artificial Sequence: Synthetic peptide
  Seed: MNQRPILTI (TP53 R248Q)
MYQRPILTV

SEQ ID NO: 20436 - protein, 9 aa, Artificial Sequence
  Description of Artificial Sequence: Synthetic peptide
  Seed: MNQRPILTI (TP53 R248Q)
MYQRPILTW

SEQ ID NO: 20437 - protein, 9 aa, Artificial Sequence
  Description of Artificial Sequence: Synthetic peptide
  Seed: MNQRPILTI (TP53 R248Q)
MYQRPILTY

SEQ ID NO: 20438 - protein, 11 aa, Artificial Sequence
  Description of Artificial Sequence: Synthetic peptide
  Seed: NSSCMGGMNQR (TP53 R248Q)
NCSCMGGMNQR

SEQ ID NO: 20439 - protein, 11 aa, Artificial Sequence
  Description of Artificial Sequence: Synthetic peptide
  Seed: NSSCMGGMNQR (TP53 R248Q)
NFSCMGGMNQK

SEQ ID NO: 20440 - protein, 11 aa, Artificial Sequence
  Description of Artificial Sequence: Synthetic peptide
  Seed: NSSCMGGMNQR (TP53 R248Q)
NGSCMGGMNQK

SEQ ID NO: 20441 - protein, 11 aa, Artificial Sequence
  Description of Artificial Sequence: Synthetic peptide
  Seed: NSSCMGGMNQR (TP53 R248Q)
NGSCMGGMNQR

SEQ ID NO: 20442 - protein, 11 aa, Artificial Sequence
  Description of Artificial Sequence: Synthetic peptide
  Seed: NSSCMGGMNQR (TP53 R248Q)
NISCMGGMNQK

SEQ ID NO: 20443 - protein, 11 aa, Artificial Sequence
  Description of Artificial Sequence: Synthetic peptide
  Seed: NSSCMGGMNQR (TP53 R248Q)
NLSCMGGMNQK

SEQ ID NO: 20444 - protein, 11 aa, Artificial Sequence
  Description of Artificial Sequence: Synthetic peptide
  Seed: NSSCMGGMNQR (TP53 R248Q)
NLSCMGGMNQR

SEQ ID NO: 20445 - protein, 11 aa, Artificial Sequence
  Description of Artificial Sequence: Synthetic peptide
  Seed: NSSCMGGMNQR (TP53 R248Q)
NMSCMGGMNQK

SEQ ID NO: 20446 - protein, 11 aa, Artificial Sequence
  Description of Artificial Sequence: Synthetic peptide
  Seed: NSSCMGGMNQR (TP53 R248Q)
NNSCMGGMNQK

SEQ ID NO: 20447 - protein, 11 aa, Artificial Sequence
  Description of Artificial Sequence: Synthetic peptide
  Seed: NSSCMGGMNQR (TP53 R248Q)
NNSCMGGMNQR

SEQ ID NO: 20448 - protein, 11 aa, Artificial Sequence
  Description of Artificial Sequence: Synthetic peptide
  Seed: NSSCMGGMNQR (TP53 R248Q)
NQSCMGGMNQK

SEQ ID NO: 20449 - protein, 11 aa, Artificial Sequence
  Description of Artificial Sequence: Synthetic peptide
  Seed: NSSCMGGMNQR (TP53 R248Q)
NQSCMGGMNQR

SEQ ID NO: 20450 - protein, 11 aa, Artificial Sequence
  Description of Artificial Sequence: Synthetic peptide
  Seed: NSSCMGGMNQR (TP53 R248Q)
NTSCMGGMNQY

SEQ ID NO: 20451 - protein, 11 aa, Artificial Sequence
  Description of Artificial Sequence: Synthetic peptide
  Seed: NSSCMGGMNQR (TP53 R248Q)
NWSCMGGMNQK

SEQ ID NO: 20452 - protein, 11 aa, Artificial Sequence
  Description of Artificial Sequence: Synthetic peptide
  Seed: NSSCMGGMNQR (TP53 R248Q)
NWSCMGGMNQR

SEQ ID NO: 20453 - protein, 11 aa, Artificial Sequence
  Description of Artificial Sequence: Synthetic peptide
  Seed: NSSCMGGMNQR (TP53 R248Q)
NYSCMGGMNQK

SEQ ID NO: 20454 - protein, 9 aa, Artificial Sequence
  Description of Artificial Sequence: Synthetic peptide
  Seed: QRPILTIIT (TP53 R248Q)
QHPILTIIA

SEQ ID NO: 20455 - protein, 9 aa, Artificial Sequence
  Description of Artificial Sequence: Synthetic peptide
  Seed: QRPILTIIT (TP53 R248Q)
QHPILTIIC

SEQ ID NO: 20456 - protein, 9 aa, Artificial Sequence
  Description of Artificial Sequence: Synthetic peptide
  Seed: QRPILTIIT (TP53 R248Q)
QHPILTIII

SEQ ID NO: 20457 - protein, 9 aa, Artificial Sequence
  Description of Artificial Sequence: Synthetic peptide
  Seed: QRPILTIIT (TP53 R248Q)
QHPILTIIL

SEQ ID NO: 20458 - protein, 9 aa, Artificial Sequence
  Description of Artificial Sequence: Synthetic peptide
  Seed: QRPILTIIT (TP53 R248Q)
QHPILTIIM

SEQ ID NO: 20459 - protein, 9 aa, Artificial Sequence
  Description of Artificial Sequence: Synthetic peptide
  Seed: QRPILTIIT (TP53 R248Q)
QHPILTIIP

SEQ ID NO: 20460 - protein, 9 aa, Artificial Sequence
  Description of Artificial Sequence: Synthetic peptide
  Seed: QRPILTIIT (TP53 R248Q)
QHPILTIIT

SEQ ID NO: 20461 - protein, 9 aa, Artificial Sequence
  Description of Artificial Sequence: Synthetic peptide
  Seed: QRPILTIIT (TP53 R248Q)
QHPILTIIV

SEQ ID NO: 20462 - protein, 8 aa, Artificial Sequence
  Description of Artificial Sequence: Synthetic peptide
  Seed: QRPILTII (TP53 R248Q)
QHPILTIL

SEQ ID NO: 20463 - protein, 8 aa, Artificial Sequence
  Description of Artificial Sequence: Synthetic peptide
  Seed: QRPILTII (TP53 R248Q)
QHPILTIM

SEQ ID NO: 20464 - protein, 9 aa, Artificial Sequence
  Description of Artificial Sequence: Synthetic peptide
  Seed: QRPILTIIT (TP53 R248Q)
QPPILTIIA

SEQ ID NO: 20465 - protein, 9 aa, Artificial Sequence
  Description of Artificial Sequence: Synthetic peptide
  Seed: QRPILTIIT (TP53 R248Q)
QQPILTIIA

SEQ ID NO: 20466 - protein, 9 aa, Artificial Sequence
  Description of Artificial Sequence: Synthetic peptide
  Seed: QRPILTIIT (TP53 R248Q)
QQPILTIII

SEQ ID NO: 20467 - protein, 9 aa, Artificial Sequence
  Description of Artificial Sequence: Synthetic peptide
  Seed: QRPILTIIT (TP53 R248Q)
QQPILTIIL

SEQ ID NO: 20468 - protein, 9 aa, Artificial Sequence
  Description of Artificial Sequence: Synthetic peptide
  Seed: QRPILTIIT (TP53 R248Q)
QQPILTIIV

SEQ ID NO: 20469 - protein, 8 aa, Artificial Sequence
  Description of Artificial Sequence: Synthetic peptide
  Seed: QRPILTII (TP53 R248Q)
QQPILTIL

SEQ ID NO: 20470 - protein, 9 aa, Artificial Sequence
  Description of Artificial Sequence: Synthetic peptide
  Seed: QRPILTIIT (TP53 R248Q)
QRPILTIIA

SEQ ID NO: 20471 - protein, 9 aa, Artificial Sequence
  Description of Artificial Sequence: Synthetic peptide
  Seed: QRPILTIIT (TP53 R248Q)
QRPILTIIC

SEQ ID NO: 20472 - protein, 9 aa, Artificial Sequence
  Description of Artificial Sequence: Synthetic peptide
  Seed: QRPILTIIT (TP53 R248Q)
QRPILTIII

SEQ ID NO: 20473 - protein, 9 aa, Artificial Sequence
  Description of Artificial Sequence: Synthetic peptide
  Seed: QRPILTIIT (TP53 R248Q)
QRPILTIIL

SEQ ID NO: 20474 - protein, 9 aa, Artificial Sequence
  Description of Artificial Sequence: Synthetic peptide
  Seed: QRPILTIIT (TP53 R248Q)
QRPILTIIP

SEQ ID NO: 20475 - protein, 10 aa, Artificial Sequence
  Description of Artificial Sequence: Synthetic peptide
  Seed: QRPILTIITL (TP53 R248Q)
QRPILTIITW

SEQ ID NO: 20476 - protein, 10 aa, Artificial Sequence
  Description of Artificial Sequence: Synthetic peptide
  Seed: QRPILTIITL (TP53 R248Q)
QRPILTIITY

SEQ ID NO: 20477 - protein, 9 aa, Artificial Sequence
  Description of Artificial Sequence: Synthetic peptide
  Seed: QRPILTIIT (TP53 R248Q)
QRPILTIIV

SEQ ID NO: 20478 - protein, 8 aa, Artificial Sequence
  Description of Artificial Sequence: Synthetic peptide
  Seed: QRPILTII (TP53 R248Q)
QRPILTIL

SEQ ID NO: 20479 - protein, 8 aa, Artificial Sequence
  Description of Artificial Sequence: Synthetic peptide
  Seed: QRPILTII (TP53 R248Q)
QRPILTIM

SEQ ID NO: 20480 - protein, 10 aa, Artificial Sequence
  Description of Artificial Sequence: Synthetic peptide
  Seed: QRPILTIITL (TP53 R248Q)
QYPILTIITY

SEQ ID NO: 20481 - protein, 10 aa, Artificial Sequence
  Description of Artificial Sequence: Synthetic peptide
  Seed: SSCMGGMNQR (TP53 R248Q)
SACMGGMNQF

SEQ ID NO: 20482 - protein, 10 aa, Artificial Sequence
  Description of Artificial Sequence: Synthetic peptide
  Seed: SSCMGGMNQR (TP53 R248Q)
SACMGGMNQL

SEQ ID NO: 20483 - protein, 10 aa, Artificial Sequence
  Description of Artificial Sequence: Synthetic peptide
  Seed: SSCMGGMNQR (TP53 R248Q)
SACMGGMNQM

SEQ ID NO: 20484 - protein, 10 aa, Artificial Sequence
  Description of Artificial Sequence: Synthetic peptide
  Seed: SSCMGGMNQR (TP53 R248Q)
SACMGGMNQY

SEQ ID NO: 20485 - protein, 9 aa, Artificial Sequence
  Description of Artificial Sequence: Synthetic peptide
  Seed: SCMGGMNQR (TP53 R248Q)
SAMGGMNQA

SEQ ID NO: 20486 - protein, 9 aa, Artificial Sequence
  Description of Artificial Sequence: Synthetic peptide
  Seed: SCMGGMNQR (TP53 R248Q)
SAMGGMNQC

SEQ ID NO: 20487 - protein, 9 aa, Artificial Sequence
  Description of Artificial Sequence: Synthetic peptide
  Seed: SCMGGMNQR (TP53 R248Q)
SAMGGMNQF

SEQ ID NO: 20488 - protein, 9 aa, Artificial Sequence
  Description of Artificial Sequence: Synthetic peptide
  Seed: SCMGGMNQR (TP53 R248Q)
SAMGGMNQH

SEQ ID NO: 20489 - protein, 9 aa, Artificial Sequence
  Description of Artificial Sequence: Synthetic peptide
  Seed: SCMGGMNQR (TP53 R248Q)
SAMGGMNQI

SEQ ID NO: 20490 - protein, 9 aa, Artificial Sequence
  Description of Artificial Sequence: Synthetic peptide
  Seed: SCMGGMNQR (TP53 R248Q)
SAMGGMNQL

SEQ ID NO: 20491 - protein, 9 aa, Artificial Sequence
  Description of Artificial Sequence: Synthetic peptide
  Seed: SCMGGMNQR (TP53 R248Q)
SAMGGMNQM

SEQ ID NO: 20492 - protein, 9 aa, Artificial Sequence
  Description of Artificial Sequence: Synthetic peptide
  Seed: SCMGGMNQR (TP53 R248Q)
SAMGGMNQV

SEQ ID NO: 20493 - protein, 9 aa, Artificial Sequence
  Description of Artificial Sequence: Synthetic peptide
  Seed: SCMGGMNQR (TP53 R248Q)
SAMGGMNQW

SEQ ID NO: 20494 - protein, 10 aa, Artificial Sequence
  Description of Artificial Sequence: Synthetic peptide
  Seed: SSCMGGMNQR (TP53 R248Q)
SCCMGGMNQK

SEQ ID NO: 20495 - protein, 10 aa, Artificial Sequence
  Description of Artificial Sequence: Synthetic peptide
  Seed: SSCMGGMNQR (TP53 R248Q)
SCCMGGMNQY

SEQ ID NO: 20496 - protein, 9 aa, Artificial Sequence
  Description of Artificial Sequence: Synthetic peptide
  Seed: SCMGGMNQR (TP53 R248Q)
SCMGGMNQF

SEQ ID NO: 20497 - protein, 9 aa, Artificial Sequence
  Description of Artificial Sequence: Synthetic peptide
  Seed: SCMGGMNQR (TP53 R248Q)
SCMGGMNQK

SEQ ID NO: 20498 - protein, 9 aa, Artificial Sequence
  Description of Artificial Sequence: Synthetic peptide
  Seed: SCMGGMNQR (TP53 R248Q)
SCMGGMNQL

SEQ ID NO: 20499 - protein, 9 aa, Artificial Sequence
  Description of Artificial Sequence: Synthetic peptide
  Seed: SCMGGMNQR (TP53 R248Q)
SCMGGMNQM

SEQ ID NO: 20500 - protein, 10 aa, Artificial Sequence
  Description of Artificial Sequence: Synthetic peptide
  Seed: SSCMGGMNQR (TP53 R248Q)
SDCMGGMNQK

SEQ ID NO: 20501 - protein, 10 aa, Artificial Sequence
  Description of Artificial Sequence: Synthetic peptide
  Seed: SSCMGGMNQR (TP53 R248Q)
SDCMGGMNQR

SEQ ID NO: 20502 - protein, 10 aa, Artificial Sequence
  Description of Artificial Sequence: Synthetic peptide
  Seed: SSCMGGMNQR (TP53 R248Q)
SDCMGGMNQY

SEQ ID NO: 20503 - protein, 9 aa, Artificial Sequence
  Description of Artificial Sequence: Synthetic peptide
  Seed: SCMGGMNQR (TP53 R248Q)
SDMGGMNQK

SEQ ID NO: 20504 - protein, 9 aa, Artificial Sequence
  Description of Artificial Sequence: Synthetic peptide
  Seed: SCMGGMNQR (TP53 R248Q)
SDMGGMNQR

SEQ ID NO: 20505 - protein, 10 aa, Artificial Sequence
  Description of Artificial Sequence: Synthetic peptide
  Seed: SSCMGGMNQR (TP53 R248Q)
SECMGGMNQK

SEQ ID NO: 20506 - protein, 10 aa, Artificial Sequence
  Description of Artificial Sequence: Synthetic peptide
  Seed: SSCMGGMNQR (TP53 R248Q)
SECMGGMNQR

SEQ ID NO: 20507 - protein, 10 aa, Artificial Sequence
  Description of Artificial Sequence: Synthetic peptide
  Seed: SSCMGGMNQR (TP53 R248Q)
SECMGGMNQY

SEQ ID NO: 20508 - protein, 9 aa, Artificial Sequence
  Description of Artificial Sequence: Synthetic peptide
  Seed: SCMGGMNQR (TP53 R248Q)
SEMGGMNQK

SEQ ID NO: 20509 - protein, 9 aa, Artificial Sequence
  Description of Artificial Sequence: Synthetic peptide
  Seed: SCMGGMNQR (TP53 R248Q)
SEMGGMNQR

SEQ ID NO: 20510 - protein, 10 aa, Artificial Sequence
  Description of Artificial Sequence: Synthetic peptide
  Seed: SSCMGGMNQR (TP53 R248Q)
SFCMGGMNQY

SEQ ID NO: 20511 - protein, 9 aa, Artificial Sequence
  Description of Artificial Sequence: Synthetic peptide
  Seed: SCMGGMNQR (TP53 R248Q)
SFMGGMNQL

SEQ ID NO: 20512 - protein, 9 aa, Artificial Sequence
  Description of Artificial Sequence: Synthetic peptide
  Seed: SCMGGMNQR (TP53 R248Q)
SFMGGMNQM

SEQ ID NO: 20513 - protein, 9 aa, Artificial Sequence
  Description of Artificial Sequence: Synthetic peptide
  Seed: SCMGGMNQR (TP53 R248Q)
SFMGGMNQY

SEQ ID NO: 20514 - protein, 10 aa, Artificial Sequence
  Description of Artificial Sequence: Synthetic peptide
  Seed: SSCMGGMNQR (TP53 R248Q)
SGCMGGMNQY

SEQ ID NO: 20515 - protein, 9 aa, Artificial Sequence
  Description of Artificial Sequence: Synthetic peptide
  Seed: SCMGGMNQR (TP53 R248Q)
SGMGGMNQF

SEQ ID NO: 20516 - protein, 9 aa, Artificial Sequence
  Description of Artificial Sequence: Synthetic peptide
  Seed: SCMGGMNQR (TP53 R248Q)
SGMGGMNQI

SEQ ID NO: 20517 - protein, 9 aa, Artificial Sequence
  Description of Artificial Sequence: Synthetic peptide
  Seed: SCMGGMNQR (TP53 R248Q)
SGMGGMNQL

SEQ ID NO: 20518 - protein, 9 aa, Artificial Sequence
  Description of Artificial Sequence: Synthetic peptide
  Seed: SCMGGMNQR (TP53 R248Q)
SGMGGMNQM

SEQ ID NO: 20519 - protein, 9 aa, Artificial Sequence
  Description of Artificial Sequence: Synthetic peptide
  Seed: SCMGGMNQR (TP53 R248Q)
SGMGGMNQV

SEQ ID NO: 20520 - protein, 9 aa, Artificial Sequence
  Description of Artificial Sequence: Synthetic peptide
  Seed: SCMGGMNQR (TP53 R248Q)
SGMGGMNQY

SEQ ID NO: 20521 - protein, 9 aa, Artificial Sequence
  Description of Artificial Sequence: Synthetic peptide
  Seed: SCMGGMNQR (TP53 R248Q)
SHMGGMNQK

SEQ ID NO: 20522 - protein, 9 aa, Artificial Sequence
  Description of Artificial Sequence: Synthetic peptide
  Seed: SCMGGMNQR (TP53 R248Q)
SIMGGMNQF

SEQ ID NO: 20523 - protein, 9 aa, Artificial Sequence
  Description of Artificial Sequence: Synthetic peptide
  Seed: SCMGGMNQR (TP53 R248Q)
SIMGGMNQH

SEQ ID NO: 20524 - protein, 9 aa, Artificial Sequence
  Description of Artificial Sequence: Synthetic peptide
  Seed: SCMGGMNQR (TP53 R248Q)
SIMGGMNQI

SEQ ID NO: 20525 - protein, 9 aa, Artificial Sequence
  Description of Artificial Sequence: Synthetic peptide
  Seed: SCMGGMNQR (TP53 R248Q)
SIMGGMNQL

SEQ ID NO: 20526 - protein, 9 aa, Artificial Sequence
  Description of Artificial Sequence: Synthetic peptide
  Seed: SCMGGMNQR (TP53 R248Q)
SIMGGMNQM

SEQ ID NO: 20527 - protein, 9 aa, Artificial Sequence
  Description of Artificial Sequence: Synthetic peptide
  Seed: SCMGGMNQR (TP53 R248Q)
SIMGGMNQV

SEQ ID NO: 20528 - protein, 9 aa, Artificial Sequence
  Description of Artificial Sequence: Synthetic peptide
  Seed: SCMGGMNQR (TP53 R248Q)
SKMGGMNQR

SEQ ID NO: 20529 - protein, 10 aa, Artificial Sequence
  Description of Artificial Sequence: Synthetic peptide
  Seed: SSCMGGMNQR (TP53 R248Q)
SLCMGGMNQY

SEQ ID NO: 20530 - protein, 9 aa, Artificial Sequence
  Description of Artificial Sequence: Synthetic peptide
  Seed: SCMGGMNQR (TP53 R248Q)
SLMGGMNQA

SEQ ID NO: 20531 - protein, 9 aa, Artificial Sequence
  Description of Artificial Sequence: Synthetic peptide
  Seed: SCMGGMNQR (TP53 R248Q)
SLMGGMNQF

SEQ ID NO: 20532 - protein, 9 aa, Artificial Sequence
  Description of Artificial Sequence: Synthetic peptide
  Seed: SCMGGMNQR (TP53 R248Q)
SLMGGMNQH

SEQ ID NO: 20533 - protein, 9 aa, Artificial Sequence
  Description of Artificial Sequence: Synthetic peptide
  Seed: SCMGGMNQR (TP53 R248Q)
SLMGGMNQI

SEQ ID NO: 20534 - protein, 9 aa, Artificial Sequence
  Description of Artificial Sequence: Synthetic peptide
  Seed: SCMGGMNQR (TP53 R248Q)
SLMGGMNQL

SEQ ID NO: 20535 - protein, 9 aa, Artificial Sequence
  Description of Artificial Sequence: Synthetic peptide
  Seed: SCMGGMNQR (TP53 R248Q)
SLMGGMNQM

SEQ ID NO: 20536 - protein, 9 aa, Artificial Sequence
  Description of Artificial Sequence: Synthetic peptide
  Seed: SCMGGMNQR (TP53 R248Q)
SLMGGMNQV

SEQ ID NO: 20537 - protein, 9 aa, Artificial Sequence
  Description of Artificial Sequence: Synthetic peptide
  Seed: SCMGGMNQR (TP53 R248Q)
SLMGGMNQY

SEQ ID NO: 20538 - protein, 10 aa, Artificial Sequence
  Description of Artificial Sequence: Synthetic peptide
  Seed: SSCMGGMNQR (TP53 R248Q)
SMCMGGMNQY

SEQ ID NO: 20539 - protein, 9 aa, Artificial Sequence
  Description of Artificial Sequence: Synthetic peptide
  Seed: SCMGGMNQR (TP53 R248Q)
SMMGGMNQA

SEQ ID NO: 20540 - protein, 9 aa, Artificial Sequence
  Description of Artificial Sequence: Synthetic peptide
  Seed: SCMGGMNQR (TP53 R248Q)
SMMGGMNQF

SEQ ID NO: 20541 - protein, 9 aa, Artificial Sequence
  Description of Artificial Sequence: Synthetic peptide
  Seed: SCMGGMNQR (TP53 R248Q)
SMMGGMNQH

SEQ ID NO: 20542 - protein, 9 aa, Artificial Sequence
  Description of Artificial Sequence: Synthetic peptide
  Seed: SCMGGMNQR (TP53 R248Q)
SMMGGMNQI

SEQ ID NO: 20543 - protein, 9 aa, Artificial Sequence
  Description of Artificial Sequence: Synthetic peptide
  Seed: SCMGGMNQR (TP53 R248Q)
SMMGGMNQL

SEQ ID NO: 20544 - protein, 9 aa, Artificial Sequence
  Description of Artificial Sequence: Synthetic peptide
  Seed: SCMGGMNQR (TP53 R248Q)
SMMGGMNQM

SEQ ID NO: 20545 - protein, 9 aa, Artificial Sequence
  Description of Artificial Sequence: Synthetic peptide
  Seed: SCMGGMNQR (TP53 R248Q)
SMMGGMNQV

SEQ ID NO: 20546 - protein, 9 aa, Artificial Sequence
  Description of Artificial Sequence: Synthetic peptide
  Seed: SCMGGMNQR (TP53 R248Q)
SMMGGMNQY

SEQ ID NO: 20547 - protein, 10 aa, Artificial Sequence
  Description of Artificial Sequence: Synthetic peptide
  Seed: SSCMGGMNQR (TP53 R248Q)
SNCMGGMNQK

SEQ ID NO: 20548 - protein, 10 aa, Artificial Sequence
  Description of Artificial Sequence: Synthetic peptide
  Seed: SSCMGGMNQR (TP53 R248Q)
SNCMGGMNQY

SEQ ID NO: 20549 - protein, 9 aa, Artificial Sequence
  Description of Artificial Sequence: Synthetic peptide
  Seed: SCMGGMNQR (TP53 R248Q)
SNMGGMNQL

SEQ ID NO: 20550 - protein, 9 aa, Artificial Sequence
  Description of Artificial Sequence: Synthetic peptide
  Seed: SCMGGMNQR (TP53 R248Q)
SNMGGMNQM

SEQ ID NO: 20551 - protein, 10 aa, Artificial Sequence
  Description of Artificial Sequence: Synthetic peptide
  Seed: SSCMGGMNQR (TP53 R248Q)
SPCMGGMNQR

SEQ ID NO: 20552 - protein, 9 aa, Artificial Sequence
  Description of Artificial Sequence: Synthetic peptide
  Seed: SCMGGMNQR (TP53 R248Q)
SPMGGMNQK

SEQ ID NO: 20553 - protein, 9 aa, Artificial Sequence
  Description of Artificial Sequence: Synthetic peptide
  Seed: SCMGGMNQR (TP53 R248Q)
SPMGGMNQL

SEQ ID NO: 20554 - protein, 9 aa, Artificial Sequence
  Description of Artificial Sequence: Synthetic peptide
  Seed: SCMGGMNQR (TP53 R248Q)
SPMGGMNQM

SEQ ID NO: 20555 - protein, 10 aa, Artificial Sequence
  Description of Artificial Sequence: Synthetic peptide
  Seed: SSCMGGMNQR (TP53 R248Q)
SQCMGGMNQY

SEQ ID NO: 20556 - protein, 9 aa, Artificial Sequence
  Description of Artificial Sequence: Synthetic peptide
  Seed: SCMGGMNQR (TP53 R248Q)
SQMGGMNQF

SEQ ID NO: 20557 - protein, 9 aa, Artificial Sequence
  Description of Artificial Sequence: Synthetic peptide
  Seed: SCMGGMNQR (TP53 R248Q)
SQMGGMNQI

SEQ ID NO: 20558 - protein, 9 aa, Artificial Sequence
  Description of Artificial Sequence: Synthetic peptide
  Seed: SCMGGMNQR (TP53 R248Q)
SQMGGMNQL

SEQ ID NO: 20559 - protein, 9 aa, Artificial Sequence
  Description of Artificial Sequence: Synthetic peptide
  Seed: SCMGGMNQR (TP53 R248Q)
SQMGGMNQM

SEQ ID NO: 20560 - protein, 9 aa, Artificial Sequence
  Description of Artificial Sequence: Synthetic peptide
  Seed: SCMGGMNQR (TP53 R248Q)
SQMGGMNQV

SEQ ID NO: 20561 - protein, 9 aa, Artificial Sequence
  Description of Artificial Sequence: Synthetic peptide
  Seed: SCMGGMNQR (TP53 R248Q)
SQMGGMNQY

SEQ ID NO: 20562 - protein, 9 aa, Artificial Sequence
  Description of Artificial Sequence: Synthetic peptide
  Seed: SCMGGMNQR (TP53 R248Q)
SRMGGMNQR

SEQ ID NO: 20563 - protein, 10 aa, Artificial Sequence
  Description of Artificial Sequence: Synthetic peptide
  Seed: SSCMGGMNQR (TP53 R248Q)
SSCMGGMNQF

SEQ ID NO: 20564 - protein, 10 aa, Artificial Sequence
  Description of Artificial Sequence: Synthetic peptide
  Seed: SSCMGGMNQR (TP53 R248Q)
SSCMGGMNQL

SEQ ID NO: 20565 - protein, 10 aa, Artificial Sequence
  Description of Artificial Sequence: Synthetic peptide
  Seed: SSCMGGMNQR (TP53 R248Q)
SSCMGGMNQM

SEQ ID NO: 20566 - protein, 9 aa, Artificial Sequence
  Description of Artificial Sequence: Synthetic peptide
  Seed: SCMGGMNQR (TP53 R248Q)
SSMGGMNQF

SEQ ID NO: 20567 - protein, 9 aa, Artificial Sequence
  Description of Artificial Sequence: Synthetic peptide
  Seed: SCMGGMNQR (TP53 R248Q)
SSMGGMNQH

SEQ ID NO: 20568 - protein, 9 aa, Artificial Sequence
  Description of Artificial Sequence: Synthetic peptide
  Seed: SCMGGMNQR (TP53 R248Q)
SSMGGMNQI

SEQ ID NO: 20569 - protein, 9 aa, Artificial Sequence
  Description of Artificial Sequence: Synthetic peptide
  Seed: SCMGGMNQR (TP53 R248Q)
SSMGGMNQL

SEQ ID NO: 20570 - protein, 9 aa, Artificial Sequence
  Description of Artificial Sequence: Synthetic peptide
  Seed: SCMGGMNQR (TP53 R248Q)
SSMGGMNQM

SEQ ID NO: 20571 - protein, 9 aa, Artificial Sequence
  Description of Artificial Sequence: Synthetic peptide
  Seed: SCMGGMNQR (TP53 R248Q)
SSMGGMNQV

SEQ ID NO: 20572 - protein, 10 aa, Artificial Sequence
  Description of Artificial Sequence: Synthetic peptide
  Seed: SSCMGGMNQR (TP53 R248Q)
STCMGGMNQF

SEQ ID NO: 20573 - protein, 10 aa, Artificial Sequence
  Description of Artificial Sequence: Synthetic peptide
  Seed: SSCMGGMNQR (TP53 R248Q)
STCMGGMNQH

SEQ ID NO: 20574 - protein, 10 aa, Artificial Sequence
  Description of Artificial Sequence: Synthetic peptide
  Seed: SSCMGGMNQR (TP53 R248Q)
STCMGGMNQL

SEQ ID NO: 20575 - protein, 10 aa, Artificial Sequence
  Description of Artificial Sequence: Synthetic peptide
  Seed: SSCMGGMNQR (TP53 R248Q)
STCMGGMNQM

SEQ ID NO: 20576 - protein, 9 aa, Artificial Sequence
  Description of Artificial Sequence: Synthetic peptide
  Seed: SCMGGMNQR (TP53 R248Q)
STMGGMNQA

SEQ ID NO: 20577 - protein, 9 aa, Artificial Sequence
  Description of Artificial Sequence: Synthetic peptide
  Seed: SCMGGMNQR (TP53 R248Q)
STMGGMNQF

SEQ ID NO: 20578 - protein, 9 aa, Artificial Sequence
  Description of Artificial Sequence: Synthetic peptide
  Seed: SCMGGMNQR (TP53 R248Q)
STMGGMNQH

SEQ ID NO: 20579 - protein, 9 aa, Artificial Sequence
  Description of Artificial Sequence: Synthetic peptide
  Seed: SCMGGMNQR (TP53 R248Q)
STMGGMNQI

SEQ ID NO: 20580 - protein, 9 aa, Artificial Sequence
  Description of Artificial Sequence: Synthetic peptide
  Seed: SCMGGMNQR (TP53 R248Q)
STMGGMNQL

SEQ ID NO: 20581 - protein, 9 aa, Artificial Sequence
  Description of Artificial Sequence: Synthetic peptide
  Seed: SCMGGMNQR (TP53 R248Q)
STMGGMNQQ

SEQ ID NO: 20582 - protein, 9 aa, Artificial Sequence
  Description of Artificial Sequence: Synthetic peptide
  Seed: SCMGGMNQR (TP53 R248Q)
STMGGMNQV

SEQ ID NO: 20583 - protein, 10 aa, Artificial Sequence
  Description of Artificial Sequence: Synthetic peptide
  Seed: SSCMGGMNQR (TP53 R248Q)
SVCMGGMNQL

SEQ ID NO: 20584 - protein, 10 aa, Artificial Sequence
  Description of Artificial Sequence: Synthetic peptide
  Seed: SSCMGGMNQR (TP53 R248Q)
SVCMGGMNQM

SEQ ID NO: 20585 - protein, 9 aa, Artificial Sequence
  Description of Artificial Sequence: Synthetic peptide
  Seed: SCMGGMNQR (TP53 R248Q)
SVMGGMNQA

SEQ ID NO: 20586 - protein, 9 aa, Artificial Sequence
  Description of Artificial Sequence: Synthetic peptide
  Seed: SCMGGMNQR (TP53 R248Q)
SVMGGMNQF

SEQ ID NO: 20587 - protein, 9 aa, Artificial Sequence
  Description of Artificial Sequence: Synthetic peptide
  Seed: SCMGGMNQR (TP53 R248Q)
SVMGGMNQH

SEQ ID NO: 20588 - protein, 9 aa, Artificial Sequence
  Description of Artificial Sequence: Synthetic peptide
  Seed: SCMGGMNQR (TP53 R248Q)
SVMGGMNQI

SEQ ID NO: 20589 - protein, 9 aa, Artificial Sequence
  Description of Artificial Sequence: Synthetic peptide
  Seed: SCMGGMNQR (TP53 R248Q)
SVMGGMNQL

SEQ ID NO: 20590 - protein, 9 aa, Artificial Sequence
  Description of Artificial Sequence: Synthetic peptide
  Seed: SCMGGMNQR (TP53 R248Q)
SVMGGMNQQ

SEQ ID NO: 20591 - protein, 9 aa, Artificial Sequence
  Description of Artificial Sequence: Synthetic peptide
  Seed: SCMGGMNQR (TP53 R248Q)
SVMGGMNQV

SEQ ID NO: 20592 - protein, 9 aa, Artificial Sequence
  Description of Artificial Sequence: Synthetic peptide
  Seed: SCMGGMNQR (TP53 R248Q)
SVMGGMNQW

SEQ ID NO: 20593 - protein, 10 aa, Artificial Sequence
  Description of Artificial Sequence: Synthetic peptide
  Seed: SSCMGGMNQR (TP53 R248Q)
SWCMGGMNQY

SEQ ID NO: 20594 - protein, 10 aa, Artificial Sequence
  Description of Artificial Sequence: Synthetic peptide
  Seed: SSCMGGMNQR (TP53 R248Q)
SYCMGGMNQY

SEQ ID NO: 20595 - protein, 9 aa, Artificial Sequence
  Description of Artificial Sequence: Synthetic peptide
  Seed: SCMGGMNQR (TP53 R248Q)
SYMGGMNQY

SEQ ID NO: 20596 - protein, 10 aa, Homo sapiens
  Native (TP53 R248Q)
GMNQRPILTI

SEQ ID NO: 20597 - protein, 11 aa, Homo sapiens
  Native (TP53 R248Q)
GMNQRPILTII

SEQ ID NO: 20598 - protein, 10 aa, Homo sapiens
  Native (TP53 R248Q)
MNQRPILTII

SEQ ID NO: 20599 - protein, 11 aa, Homo sapiens
  Native (TP53 R248Q)
NSSCMGGMNQR

SEQ ID NO: 20600 - protein, 10 aa, Homo sapiens
  Native (TP53 R248Q)
QRPILTIITL

SEQ ID NO: 20601 - protein, 9 aa, Homo sapiens
  Native (TP53 R248Q)
SCMGGMNQR

SEQ ID NO: 20602 - protein, 10 aa, Homo sapiens
  Native (TP53 R248Q)
SSCMGGMNQR

SEQ ID NO: 20603 - protein, 9 aa, Homo sapiens
  Native (TP53 R248Q)
GGMNQRPIL

SEQ ID NO: 20604 - protein, 8 aa, Homo sapiens
  Native (TP53 R248Q)
GMNQRPIL

SEQ ID NO: 20605 - protein, 10 aa, Homo sapiens
  Native (TP53 R248Q)
MGGMNQRPIL

SEQ ID NO: 20606 - protein, 9 aa, Homo sapiens
  Native (TP53 R248Q)
MNQRPILTI

SEQ ID NO: 20607 - protein, 8 aa, Homo sapiens
  Native (TP53 R248Q)
QRPILTII

SEQ ID NO: 20608 - protein, 9 aa, Homo sapiens
  Native (TP53 R248Q)
QRPILTIIT

SEQ ID NO: 20609 - protein, 10 aa, Artificial Sequence
  Description of Artificial Sequence: Synthetic peptide
  Seed: CMGGMNWRPI (TP53 R248W)
CIGGMNWRPI

SEQ ID NO: 20610 - protein, 10 aa, Artificial Sequence
  Description of Artificial Sequence: Synthetic peptide
  Seed: CMGGMNWRPI (TP53 R248W)
CIGGMNWRPV

SEQ ID NO: 20611 - protein, 10 aa, Artificial Sequence
  Description of Artificial Sequence: Synthetic peptide
  Seed: CMGGMNWRPI (TP53 R248W)
CLGGMNWRPA

SEQ ID NO: 20612 - protein, 10 aa, Artificial Sequence
  Description of Artificial Sequence: Synthetic peptide
  Seed: CMGGMNWRPI (TP53 R248W)
CLGGMNWRPI

SEQ ID NO: 20613 - protein, 11 aa, Artificial Sequence
  Description of Artificial Sequence: Synthetic peptide
  Seed: CMGGMNWRPIL (TP53 R248W)
CLGGMNWRPII

SEQ ID NO: 20614 - protein, 11 aa, Artificial Sequence
  Description of Artificial Sequence: Synthetic peptide
  Seed: CMGGMNWRPIL (TP53 R248W)
CLGGMNWRPIL

SEQ ID NO: 20615 - protein, 11 aa, Artificial Sequence
  Description of Artificial Sequence: Synthetic peptide
  Seed: CMGGMNWRPIL (TP53 R248W)
CLGGMNWRPIV

SEQ ID NO: 20616 - protein, 10 aa, Artificial Sequence
  Description of Artificial Sequence: Synthetic peptide
  Seed: CMGGMNWRPI (TP53 R248W)
CLGGMNWRPL

SEQ ID NO: 20617 - protein, 10 aa, Artificial Sequence
  Description of Artificial Sequence: Synthetic peptide
  Seed: CMGGMNWRPI (TP53 R248W)
CLGGMNWRPM

SEQ ID NO: 20618 - protein, 10 aa, Artificial Sequence
  Description of Artificial Sequence: Synthetic peptide
  Seed: CMGGMNWRPI (TP53 R248W)
CLGGMNWRPV

SEQ ID NO: 20619 - protein, 10 aa, Artificial Sequence
  Description of Artificial Sequence: Synthetic peptide
  Seed: CMGGMNWRPI (TP53 R248W)
CMGGMNWRPA

SEQ ID NO: 20620 - protein, 11 aa, Artificial Sequence
  Description of Artificial Sequence: Synthetic peptide
  Seed: CMGGMNWRPIL (TP53 R248W)
CMGGMNWRPIV

SEQ ID NO: 20621 - protein, 10 aa, Artificial Sequence
  Description of Artificial Sequence: Synthetic peptide
  Seed: CMGGMNWRPI (TP53 R248W)
CMGGMNWRPL

SEQ ID NO: 20622 - protein, 10 aa, Artificial Sequence
  Description of Artificial Sequence: Synthetic peptide
  Seed: CMGGMNWRPI (TP53 R248W)
CMGGMNWRPM

SEQ ID NO: 20623 - protein, 10 aa, Artificial Sequence
  Description of Artificial Sequence: Synthetic peptide
  Seed: CMGGMNWRPI (TP53 R248W)
CMGGMNWRPV

SEQ ID NO: 20624 - protein, 10 aa, Artificial Sequence
  Description of Artificial Sequence: Synthetic peptide
  Seed: CMGGMNWRPI (TP53 R248W)
CQGGMNWRPV

SEQ ID NO: 20625 - protein, 10 aa, Artificial Sequence
  Description of Artificial Sequence: Synthetic peptide
  Seed: CMGGMNWRPI (TP53 R248W)
CTGGMNWRPV

SEQ ID NO: 20626 - protein, 10 aa, Artificial Sequence
  Description of Artificial Sequence: Synthetic peptide
  Seed: CMGGMNWRPI (TP53 R248W)
CVGGMNWRPV

SEQ ID NO: 20627 - protein, 9 aa, Artificial Sequence
  Description of Artificial Sequence: Synthetic peptide
  Seed: GMNWRPILT (TP53 R248W)
GINWRPILI

SEQ ID NO: 20628 - protein, 9 aa, Artificial Sequence
  Description of Artificial Sequence: Synthetic peptide
  Seed: GMNWRPILT (TP53 R248W)
GINWRPILL

SEQ ID NO: 20629 - protein, 10 aa, Artificial Sequence
  Description of Artificial Sequence: Synthetic peptide
  Seed: GMNWRPILTI (TP53 R248W)
GINWRPILTI

SEQ ID NO: 20630 - protein, 10 aa, Artificial Sequence
  Description of Artificial Sequence: Synthetic peptide
  Seed: GMNWRPILTI (TP53 R248W)
GINWRPILTL

SEQ ID NO: 20631 - protein, 10 aa, Artificial Sequence
  Description of Artificial Sequence: Synthetic peptide
  Seed: GMNWRPILTI (TP53 R248W)
GINWRPILTV

SEQ ID NO: 20632 - protein, 9 aa, Artificial Sequence
  Description of Artificial Sequence: Synthetic peptide
  Seed: GMNWRPILT (TP53 R248W)
GINWRPILV

SEQ ID NO: 20633 - protein, 9 aa, Artificial Sequence
  Description of Artificial Sequence: Synthetic peptide
  Seed: GMNWRPILT (TP53 R248W)
GLNWRPILA

SEQ ID NO: 20634 - protein, 9 aa, Artificial Sequence
  Description of Artificial Sequence: Synthetic peptide
  Seed: GMNWRPILT (TP53 R248W)
GLNWRPILC

SEQ ID NO: 20635 - protein, 9 aa, Artificial Sequence
  Description of Artificial Sequence: Synthetic peptide
  Seed: GMNWRPILT (TP53 R248W)
GLNWRPILI

SEQ ID NO: 20636 - protein, 9 aa, Artificial Sequence
  Description of Artificial Sequence: Synthetic peptide
  Seed: GMNWRPILT (TP53 R248W)
GLNWRPILL

SEQ ID NO: 20637 - protein, 9 aa, Artificial Sequence
  Description of Artificial Sequence: Synthetic peptide
  Seed: GMNWRPILT (TP53 R248W)
GLNWRPILM

SEQ ID NO: 20638 - protein, 9 aa, Artificial Sequence
  Description of Artificial Sequence: Synthetic peptide
  Seed: GMNWRPILT (TP53 R248W)
GLNWRPILT

SEQ ID NO: 20639 - protein, 10 aa, Artificial Sequence
  Description of Artificial Sequence: Synthetic peptide
  Seed: GMNWRPILTI (TP53 R248W)
GLNWRPILTA

SEQ ID NO: 20640 - protein, 10 aa, Artificial Sequence
  Description of Artificial Sequence: Synthetic peptide
  Seed: GMNWRPILTI (TP53 R248W)
GLNWRPILTC

SEQ ID NO: 20641 - protein, 10 aa, Artificial Sequence
  Description of Artificial Sequence: Synthetic peptide
  Seed: GMNWRPILTI (TP53 R248W)
GLNWRPILTF

SEQ ID NO: 20642 - protein, 10 aa, Artificial Sequence
  Description of Artificial Sequence: Synthetic peptide
  Seed: GMNWRPILTI (TP53 R248W)
GLNWRPILTI

SEQ ID NO: 20643 - protein, 11 aa, Artificial Sequence
  Description of Artificial Sequence: Synthetic peptide
  Seed: GMNWRPILTII (TP53 R248W)
GLNWRPILTIA

SEQ ID NO: 20644 - protein, 11 aa, Artificial Sequence
  Description of Artificial Sequence: Synthetic peptide
  Seed: GMNWRPILTII (TP53 R248W)
GLNWRPILTII

SEQ ID NO: 20645 - protein, 11 aa, Artificial Sequence
  Description of Artificial Sequence: Synthetic peptide
  Seed: GMNWRPILTII (TP53 R248W)
GLNWRPILTIL

SEQ ID NO: 20646 - protein, 11 aa, Artificial Sequence
  Description of Artificial Sequence: Synthetic peptide
  Seed: GMNWRPILTII (TP53 R248W)
GLNWRPILTIV

SEQ ID NO: 20647 - protein, 10 aa, Artificial Sequence
  Description of Artificial Sequence: Synthetic peptide
  Seed: GMNWRPILTI (TP53 R248W)
GLNWRPILTL

SEQ ID NO: 20648 - protein, 10 aa, Artificial Sequence
  Description of Artificial Sequence: Synthetic peptide
  Seed: GMNWRPILTI (TP53 R248W)
GLNWRPILTM

SEQ ID NO: 20649 - protein, 10 aa, Artificial Sequence
  Description of Artificial Sequence: Synthetic peptide
  Seed: GMNWRPILTI (TP53 R248W)
GLNWRPILTT

SEQ ID NO: 20650 - protein, 10 aa, Artificial Sequence
  Description of Artificial Sequence: Synthetic peptide
  Seed: GMNWRPILTI (TP53 R248W)
GLNWRPILTV

SEQ ID NO: 20651 - protein, 10 aa, Artificial Sequence
  Description of Artificial Sequence: Synthetic peptide
  Seed: GMNWRPILTI (TP53 R248W)
GLNWRPILTW

SEQ ID NO: 20652 - protein, 9 aa, Artificial Sequence
  Description of Artificial Sequence: Synthetic peptide
  Seed: GMNWRPILT (TP53 R248W)
GLNWRPILV

SEQ ID NO: 20653 - protein, 9 aa, Artificial Sequence
  Description of Artificial Sequence: Synthetic peptide
  Seed: GMNWRPILT (TP53 R248W)
GMNWRPILA

SEQ ID NO: 20654 - protein, 9 aa, Artificial Sequence
  Description of Artificial Sequence: Synthetic peptide
  Seed: GMNWRPILT (TP53 R248W)
GMNWRPILC

SEQ ID NO: 20655 - protein, 9 aa, Artificial Sequence
  Description of Artificial Sequence: Synthetic peptide
  Seed: GMNWRPILT (TP53 R248W)
GMNWRPILI

SEQ ID NO: 20656 - protein, 9 aa, Artificial Sequence
  Description of Artificial Sequence: Synthetic peptide
  Seed: GMNWRPILT (TP53 R248W)
GMNWRPILL

SEQ ID NO: 20657 - protein, 9 aa, Artificial Sequence
  Description of Artificial Sequence: Synthetic peptide
  Seed: GMNWRPILT (TP53 R248W)
GMNWRPILM

SEQ ID NO: 20658 - protein, 10 aa, Artificial Sequence
  Description of Artificial Sequence: Synthetic peptide
  Seed: GMNWRPILTI (TP53 R248W)
GMNWRPILTA

SEQ ID NO: 20659 - protein, 10 aa, Artificial Sequence
  Description of Artificial Sequence: Synthetic peptide
  Seed: GMNWRPILTI (TP53 R248W)
GMNWRPILTC

SEQ ID NO: 20660 - protein, 10 aa, Artificial Sequence
  Description of Artificial Sequence: Synthetic peptide
  Seed: GMNWRPILTI (TP53 R248W)
GMNWRPILTF

SEQ ID NO: 20661 - protein, 11 aa, Artificial Sequence
  Description of Artificial Sequence: Synthetic peptide
  Seed: GMNWRPILTII (TP53 R248W)
GMNWRPILTIA

SEQ ID NO: 20662 - protein, 11 aa, Artificial Sequence
  Description of Artificial Sequence: Synthetic peptide
  Seed: GMNWRPILTII (TP53 R248W)
GMNWRPILTIL

SEQ ID NO: 20663 - protein, 11 aa, Artificial Sequence
  Description of Artificial Sequence: Synthetic peptide
  Seed: GMNWRPILTII (TP53 R248W)
GMNWRPILTIV

SEQ ID NO: 20664 - protein, 10 aa, Artificial Sequence
  Description of Artificial Sequence: Synthetic peptide
  Seed: GMNWRPILTI (TP53 R248W)
GMNWRPILTL

SEQ ID NO: 20665 - protein, 10 aa, Artificial Sequence
  Description of Artificial Sequence: Synthetic peptide
  Seed: GMNWRPILTI (TP53 R248W)
GMNWRPILTM

SEQ ID NO: 20666 - protein, 10 aa, Artificial Sequence
  Description of Artificial Sequence: Synthetic peptide
  Seed: GMNWRPILTI (TP53 R248W)
GMNWRPILTT

SEQ ID NO: 20667 - protein, 10 aa, Artificial Sequence
  Description of Artificial Sequence: Synthetic peptide
  Seed: GMNWRPILTI (TP53 R248W)
GMNWRPILTW

SEQ ID NO: 20668 - protein, 9 aa, Artificial Sequence
  Description of Artificial Sequence: Synthetic peptide
  Seed: GMNWRPILT (TP53 R248W)
GMNWRPILV

SEQ ID NO: 20669 - protein, 10 aa, Artificial Sequence
  Description of Artificial Sequence: Synthetic peptide
  Seed: GMNWRPILTI (TP53 R248W)
GQNWRPILTI

SEQ ID NO: 20670 - protein, 10 aa, Artificial Sequence
  Description of Artificial Sequence: Synthetic peptide
  Seed: GMNWRPILTI (TP53 R248W)
GQNWRPILTL

SEQ ID NO: 20671 - protein, 10 aa, Artificial Sequence
  Description of Artificial Sequence: Synthetic peptide
  Seed: GMNWRPILTI (TP53 R248W)
GQNWRPILTV

SEQ ID NO: 20672 - protein, 9 aa, Artificial Sequence
  Description of Artificial Sequence: Synthetic peptide
  Seed: GMNWRPILT (TP53 R248W)
GQNWRPILV

SEQ ID NO: 20673 - protein, 10 aa, Artificial Sequence
  Description of Artificial Sequence: Synthetic peptide
  Seed: GMNWRPILTI (TP53 R248W)
GTNWRPILTF

SEQ ID NO: 20674 - protein, 10 aa, Artificial Sequence
  Description of Artificial Sequence: Synthetic peptide
  Seed: GMNWRPILTI (TP53 R248W)
GTNWRPILTV

SEQ ID NO: 20675 - protein, 10 aa, Artificial Sequence
  Description of Artificial Sequence: Synthetic peptide
  Seed: GMNWRPILTI (TP53 R248W)
GTNWRPILTW

SEQ ID NO: 20676 - protein, 9 aa, Artificial Sequence
  Description of Artificial Sequence: Synthetic peptide
  Seed: GMNWRPILT (TP53 R248W)
GTNWRPILV

SEQ ID NO: 20677 - protein, 10 aa, Artificial Sequence
  Description of Artificial Sequence: Synthetic peptide
  Seed: GMNWRPILTI (TP53 R248W)
GVNWRPILTF

SEQ ID NO: 20678 - protein, 10 aa, Artificial Sequence
  Description of Artificial Sequence: Synthetic peptide
  Seed: GMNWRPILTI (TP53 R248W)
GVNWRPILTV

SEQ ID NO: 20679 - protein, 10 aa, Artificial Sequence
  Description of Artificial Sequence: Synthetic peptide
  Seed: GMNWRPILTI (TP53 R248W)
GVNWRPILTW

SEQ ID NO: 20680 - protein, 9 aa, Artificial Sequence
  Description of Artificial Sequence: Synthetic peptide
  Seed: GMNWRPILT (TP53 R248W)
GVNWRPILV

SEQ ID NO: 20681 - protein, 9 aa, Artificial Sequence
  Description of Artificial Sequence: Synthetic peptide
  Seed: MNWRPILTI (TP53 R248W)
MAWRPILTA

SEQ ID NO: 20682 - protein, 9 aa, Artificial Sequence
  Description of Artificial Sequence: Synthetic peptide
  Seed: MNWRPILTI (TP53 R248W)
MAWRPILTF

SEQ ID NO: 20683 - protein, 9 aa, Artificial Sequence
  Description of Artificial Sequence: Synthetic peptide
  Seed: MNWRPILTI (TP53 R248W)
MAWRPILTH

SEQ ID NO: 20684 - protein, 9 aa, Artificial Sequence
  Description of Artificial Sequence: Synthetic peptide
  Seed: MNWRPILTI (TP53 R248W)
MAWRPILTI

SEQ ID NO: 20685 - protein, 9 aa, Artificial Sequence
  Description of Artificial Sequence: Synthetic peptide
  Seed: MNWRPILTI (TP53 R248W)
MAWRPILTM

SEQ ID NO: 20686 - protein, 9 aa, Artificial Sequence
  Description of Artificial Sequence: Synthetic peptide
  Seed: MNWRPILTI (TP53 R248W)
MAWRPILTV

SEQ ID NO: 20687 - protein, 9 aa, Artificial Sequence
  Description of Artificial Sequence: Synthetic peptide
  Seed: MNWRPILTI (TP53 R248W)
MAWRPILTW

SEQ ID NO: 20688 - protein, 9 aa, Artificial Sequence
  Description of Artificial Sequence: Synthetic peptide
  Seed: MNWRPILTI (TP53 R248W)
MAWRPILTY

SEQ ID NO: 20689 - protein, 9 aa, Artificial Sequence
  Description of Artificial Sequence: Synthetic peptide
  Seed: MNWRPILTI (TP53 R248W)
MCWRPILTF

SEQ ID NO: 20690 - protein, 9 aa, Artificial Sequence
  Description of Artificial Sequence: Synthetic peptide
  Seed: MNWRPILTI (TP53 R248W)
MCWRPILTI

SEQ ID NO: 20691 - protein, 9 aa, Artificial Sequence
  Description of Artificial Sequence: Synthetic peptide
  Seed: MNWRPILTI (TP53 R248W)
MCWRPILTL

SEQ ID NO: 20692 - protein, 9 aa, Artificial Sequence
  Description of Artificial Sequence: Synthetic peptide
  Seed: MNWRPILTI (TP53 R248W)
MCWRPILTM

SEQ ID NO: 20693 - protein, 9 aa, Artificial Sequence
  Description of Artificial Sequence: Synthetic peptide
  Seed: MNWRPILTI (TP53 R248W)
MCWRPILTW

SEQ ID NO: 20694 - protein, 9 aa, Artificial Sequence
  Description of Artificial Sequence: Synthetic peptide
  Seed: MNWRPILTI (TP53 R248W)
MCWRPILTY

SEQ ID NO: 20695 - protein, 9 aa, Artificial Sequence
  Description of Artificial Sequence: Synthetic peptide
  Seed: MNWRPILTI (TP53 R248W)
MDWRPILTF

SEQ ID NO: 20696 - protein, 9 aa, Artificial Sequence
  Description of Artificial Sequence: Synthetic peptide
  Seed: MNWRPILTI (TP53 R248W)
MDWRPILTY

SEQ ID NO: 20697 - protein, 9 aa, Artificial Sequence
  Description of Artificial Sequence: Synthetic peptide
  Seed: MNWRPILTI (TP53 R248W)
MEWRPILTF

SEQ ID NO: 20698 - protein, 9 aa, Artificial Sequence
  Description of Artificial Sequence: Synthetic peptide
  Seed: MNWRPILTI (TP53 R248W)
MEWRPILTH

SEQ ID NO: 20699 - protein, 9 aa, Artificial Sequence
  Description of Artificial Sequence: Synthetic peptide
  Seed: MNWRPILTI (TP53 R248W)
MEWRPILTI

SEQ ID NO: 20700 - protein, 9 aa, Artificial Sequence
  Description of Artificial Sequence: Synthetic peptide
  Seed: MNWRPILTI (TP53 R248W)
MEWRPILTL

SEQ ID NO: 20701 - protein, 9 aa, Artificial Sequence
  Description of Artificial Sequence: Synthetic peptide
  Seed: MNWRPILTI (TP53 R248W)
MEWRPILTM

SEQ ID NO: 20702 - protein, 9 aa, Artificial Sequence
  Description of Artificial Sequence: Synthetic peptide
  Seed: MNWRPILTI (TP53 R248W)
MEWRPILTW

SEQ ID NO: 20703 - protein, 9 aa, Artificial Sequence
  Description of Artificial Sequence: Synthetic peptide
  Seed: MNWRPILTI (TP53 R248W)
MEWRPILTY

SEQ ID NO: 20704 - protein, 9 aa, Artificial Sequence
  Description of Artificial Sequence: Synthetic peptide
  Seed: MNWRPILTI (TP53 R248W)
MFWRPILTF

SEQ ID NO: 20705 - protein, 9 aa, Artificial Sequence
  Description of Artificial Sequence: Synthetic peptide
  Seed: MNWRPILTI (TP53 R248W)
MFWRPILTI

SEQ ID NO: 20706 - protein, 9 aa, Artificial Sequence
  Description of Artificial Sequence: Synthetic peptide
  Seed: MNWRPILTI (TP53 R248W)
MFWRPILTL

SEQ ID NO: 20707 - protein, 9 aa, Artificial Sequence
  Description of Artificial Sequence: Synthetic peptide
  Seed: MNWRPILTI (TP53 R248W)
MFWRPILTM

SEQ ID NO: 20708 - protein, 9 aa, Artificial Sequence
  Description of Artificial Sequence: Synthetic peptide
  Seed: MNWRPILTI (TP53 R248W)
MFWRPILTW

SEQ ID NO: 20709 - protein, 9 aa, Artificial Sequence
  Description of Artificial Sequence: Synthetic peptide
  Seed: MNWRPILTI (TP53 R248W)
MFWRPILTY

SEQ ID NO: 20710 - protein, 9 aa, Artificial Sequence
  Description of Artificial Sequence: Synthetic peptide
  Seed: MNWRPILTI (TP53 R248W)
MGWRPILTF

SEQ ID NO: 20711 - protein, 9 aa, Artificial Sequence
  Description of Artificial Sequence: Synthetic peptide
  Seed: MNWRPILTI (TP53 R248W)
MGWRPILTI

SEQ ID NO: 20712 - protein, 9 aa, Artificial Sequence
  Description of Artificial Sequence: Synthetic peptide
  Seed: MNWRPILTI (TP53 R248W)
MGWRPILTL

SEQ ID NO: 20713 - protein, 9 aa, Artificial Sequence
  Description of Artificial Sequence: Synthetic peptide
  Seed: MNWRPILTI (TP53 R248W)
MGWRPILTM

SEQ ID NO: 20714 - protein, 9 aa, Artificial Sequence
  Description of Artificial Sequence: Synthetic peptide
  Seed: MNWRPILTI (TP53 R248W)
MGWRPILTV

SEQ ID NO: 20715 - protein, 9 aa, Artificial Sequence
  Description of Artificial Sequence: Synthetic peptide
  Seed: MNWRPILTI (TP53 R248W)
MGWRPILTW

SEQ ID NO: 20716 - protein, 9 aa, Artificial Sequence
  Description of Artificial Sequence: Synthetic peptide
  Seed: MNWRPILTI (TP53 R248W)
MGWRPILTY

SEQ ID NO: 20717 - protein, 9 aa, Artificial Sequence
  Description of Artificial Sequence: Synthetic peptide
  Seed: MNWRPILTI (TP53 R248W)
MHWRPILTA

SEQ ID NO: 20718 - protein, 9 aa, Artificial Sequence
  Description of Artificial Sequence: Synthetic peptide
  Seed: MNWRPILTI (TP53 R248W)
MHWRPILTF

SEQ ID NO: 20719 - protein, 9 aa, Artificial Sequence
  Description of Artificial Sequence: Synthetic peptide
  Seed: MNWRPILTI (TP53 R248W)
MHWRPILTH

SEQ ID NO: 20720 - protein, 9 aa, Artificial Sequence
  Description of Artificial Sequence: Synthetic peptide
  Seed: MNWRPILTI (TP53 R248W)
MHWRPILTI

SEQ ID NO: 20721 - protein, 9 aa, Artificial Sequence
  Description of Artificial Sequence: Synthetic peptide
  Seed: MNWRPILTI (TP53 R248W)
MHWRPILTL

SEQ ID NO: 20722 - protein, 9 aa, Artificial Sequence
  Description of Artificial Sequence: Synthetic peptide
  Seed: MNWRPILTI (TP53 R248W)
MHWRPILTM

SEQ ID NO: 20723 - protein, 9 aa, Artificial Sequence
  Description of Artificial Sequence: Synthetic peptide
  Seed: MNWRPILTI (TP53 R248W)
MHWRPILTV

SEQ ID NO: 20724 - protein, 9 aa, Artificial Sequence
  Description of Artificial Sequence: Synthetic peptide
  Seed: MNWRPILTI (TP53 R248W)
MHWRPILTW

SEQ ID NO: 20725 - protein, 9 aa, Artificial Sequence
  Description of Artificial Sequence: Synthetic peptide
  Seed: MNWRPILTI (TP53 R248W)
MHWRPILTY

SEQ ID NO: 20726 - protein, 9 aa, Artificial Sequence
  Description of Artificial Sequence: Synthetic peptide
  Seed: MNWRPILTI (TP53 R248W)
MIWRPILTF

SEQ ID NO: 20727 - protein, 9 aa, Artificial Sequence
  Description of Artificial Sequence: Synthetic peptide
  Seed: MNWRPILTI (TP53 R248W)
MIWRPILTH

SEQ ID NO: 20728 - protein, 9 aa, Artificial Sequence
  Description of Artificial Sequence: Synthetic peptide
  Seed: MNWRPILTI (TP53 R248W)
MIWRPILTI

SEQ ID NO: 20729 - protein, 9 aa, Artificial Sequence
  Description of Artificial Sequence: Synthetic peptide
  Seed: MNWRPILTI (TP53 R248W)
MIWRPILTL

SEQ ID NO: 20730 - protein, 9 aa, Artificial Sequence
  Description of Artificial Sequence: Synthetic peptide
  Seed: MNWRPILTI (TP53 R248W)
MIWRPILTM

SEQ ID NO: 20731 - protein, 9 aa, Artificial Sequence
  Description of Artificial Sequence: Synthetic peptide
  Seed: MNWRPILTI (TP53 R248W)
MIWRPILTV

SEQ ID NO: 20732 - protein, 9 aa, Artificial Sequence
  Description of Artificial Sequence: Synthetic peptide
  Seed: MNWRPILTI (TP53 R248W)
MIWRPILTW

SEQ ID NO: 20733 - protein, 9 aa, Artificial Sequence
  Description of Artificial Sequence: Synthetic peptide
  Seed: MNWRPILTI (TP53 R248W)
MIWRPILTY

SEQ ID NO: 20734 - protein, 9 aa, Artificial Sequence
  Description of Artificial Sequence: Synthetic peptide
  Seed: MNWRPILTI (TP53 R248W)
MKWRPILTA

SEQ ID NO: 20735 - protein, 9 aa, Artificial Sequence
  Description of Artificial Sequence: Synthetic peptide
  Seed: MNWRPILTI (TP53 R248W)
MKWRPILTF

SEQ ID NO: 20736 - protein, 9 aa, Artificial Sequence
  Description of Artificial Sequence: Synthetic peptide
  Seed: MNWRPILTI (TP53 R248W)
MKWRPILTG

SEQ ID NO: 20737 - protein, 9 aa, Artificial Sequence
  Description of Artificial Sequence: Synthetic peptide
  Seed: MNWRPILTI (TP53 R248W)
MKWRPILTH

SEQ ID NO: 20738 - protein, 9 aa, Artificial Sequence
  Description of Artificial Sequence: Synthetic peptide
  Seed: MNWRPILTI (TP53 R248W)
MKWRPILTI

SEQ ID NO: 20739 - protein, 9 aa, Artificial Sequence
  Description of Artificial Sequence: Synthetic peptide
  Seed: MNWRPILTI (TP53 R248W)
MKWRPILTL

SEQ ID NO: 20740 - protein, 9 aa, Artificial Sequence
  Description of Artificial Sequence: Synthetic peptide
  Seed: MNWRPILTI (TP53 R248W)
MKWRPILTM

SEQ ID NO: 20741 - protein, 9 aa, Artificial Sequence
  Description of Artificial Sequence: Synthetic peptide
  Seed: MNWRPILTI (TP53 R248W)
MKWRPILTS

SEQ ID NO: 20742 - protein, 9 aa, Artificial Sequence
  Description of Artificial Sequence: Synthetic peptide
  Seed: MNWRPILTI (TP53 R248W)
MKWRPILTT

SEQ ID NO: 20743 - protein, 9 aa, Artificial Sequence
  Description of Artificial Sequence: Synthetic peptide
  Seed: MNWRPILTI (TP53 R248W)
MKWRPILTV

SEQ ID NO: 20744 - protein, 9 aa, Artificial Sequence
  Description of Artificial Sequence: Synthetic peptide
  Seed: MNWRPILTI (TP53 R248W)
MKWRPILTW

SEQ ID NO: 20745 - protein, 9 aa, Artificial Sequence
  Description of Artificial Sequence: Synthetic peptide
  Seed: MNWRPILTI (TP53 R248W)
MKWRPILTY

SEQ ID NO: 20746 - protein, 9 aa, Artificial Sequence
  Description of Artificial Sequence: Synthetic peptide
  Seed: MNWRPILTI (TP53 R248W)
MLWRPILTA

SEQ ID NO: 20747 - protein, 9 aa, Artificial Sequence
  Description of Artificial Sequence: Synthetic peptide
  Seed: MNWRPILTI (TP53 R248W)
MLWRPILTF

SEQ ID NO: 20748 - protein, 9 aa, Artificial Sequence
  Description of Artificial Sequence: Synthetic peptide
  Seed: MNWRPILTI (TP53 R248W)
MLWRPILTH

SEQ ID NO: 20749 - protein, 9 aa, Artificial Sequence
  Description of Artificial Sequence: Synthetic peptide
  Seed: MNWRPILTI (TP53 R248W)
MLWRPILTI

SEQ ID NO: 20750 - protein, 9 aa, Artificial Sequence
  Description of Artificial Sequence: Synthetic peptide
  Seed: MNWRPILTI (TP53 R248W)
MLWRPILTL

SEQ ID NO: 20751 - protein, 9 aa, Artificial Sequence
  Description of Artificial Sequence: Synthetic peptide
  Seed: MNWRPILTI (TP53 R248W)
MLWRPILTM

SEQ ID NO: 20752 - protein, 9 aa, Artificial Sequence
  Description of Artificial Sequence: Synthetic peptide
  Seed: MNWRPILTI (TP53 R248W)
MLWRPILTV

SEQ ID NO: 20753 - protein, 9 aa, Artificial Sequence
  Description of Artificial Sequence: Synthetic peptide
  Seed: MNWRPILTI (TP53 R248W)
MLWRPILTW

SEQ ID NO: 20754 - protein, 9 aa, Artificial Sequence
  Description of Artificial Sequence: Synthetic peptide
  Seed: MNWRPILTI (TP53 R248W)
MLWRPILTY

SEQ ID NO: 20755 - protein, 9 aa, Artificial Sequence
  Description of Artificial Sequence: Synthetic peptide
  Seed: MNWRPILTI (TP53 R248W)
MMWRPILTA

SEQ ID NO: 20756 - protein, 9 aa, Artificial Sequence
  Description of Artificial Sequence: Synthetic peptide
  Seed: MNWRPILTI (TP53 R248W)
MMWRPILTC

SEQ ID NO: 20757 - protein, 9 aa, Artificial Sequence
  Description of Artificial Sequence: Synthetic peptide
  Seed: MNWRPILTI (TP53 R248W)
MMWRPILTF

SEQ ID NO: 20758 - protein, 9 aa, Artificial Sequence
  Description of Artificial Sequence: Synthetic peptide
  Seed: MNWRPILTI (TP53 R248W)
MMWRPILTG

SEQ ID NO: 20759 - protein, 9 aa, Artificial Sequence
  Description of Artificial Sequence: Synthetic peptide
  Seed: MNWRPILTI (TP53 R248W)
MMWRPILTH

SEQ ID NO: 20760 - protein, 9 aa, Artificial Sequence
  Description of Artificial Sequence: Synthetic peptide
  Seed: MNWRPILTI (TP53 R248W)
MMWRPILTI

SEQ ID NO: 20761 - protein, 9 aa, Artificial Sequence
  Description of Artificial Sequence: Synthetic peptide
  Seed: MNWRPILTI (TP53 R248W)
MMWRPILTL

SEQ ID NO: 20762 - protein, 9 aa, Artificial Sequence
  Description of Artificial Sequence: Synthetic peptide
  Seed: MNWRPILTI (TP53 R248W)
MMWRPILTM

SEQ ID NO: 20763 - protein, 9 aa, Artificial Sequence
  Description of Artificial Sequence: Synthetic peptide
  Seed: MNWRPILTI (TP53 R248W)
MMWRPILTN

SEQ ID NO: 20764 - protein, 9 aa, Artificial Sequence
  Description of Artificial Sequence: Synthetic peptide
  Seed: MNWRPILTI (TP53 R248W)
MMWRPILTP

SEQ ID NO: 20765 - protein, 9 aa, Artificial Sequence
  Description of Artificial Sequence: Synthetic peptide
  Seed: MNWRPILTI (TP53 R248W)
MMWRPILTS

SEQ ID NO: 20766 - protein, 9 aa, Artificial Sequence
  Description of Artificial Sequence: Synthetic peptide
  Seed: MNWRPILTI (TP53 R248W)
MMWRPILTT

SEQ ID NO: 20767 - protein, 9 aa, Artificial Sequence
  Description of Artificial Sequence: Synthetic peptide
  Seed: MNWRPILTI (TP53 R248W)
MMWRPILTV

SEQ ID NO: 20768 - protein, 9 aa, Artificial Sequence
  Description of Artificial Sequence: Synthetic peptide
  Seed: MNWRPILTI (TP53 R248W)
MMWRPILTW

SEQ ID NO: 20769 - protein, 9 aa, Artificial Sequence
  Description of Artificial Sequence: Synthetic peptide
  Seed: MNWRPILTI (TP53 R248W)
MMWRPILTY

SEQ ID NO: 20770 - protein, 9 aa, Artificial Sequence
  Description of Artificial Sequence: Synthetic peptide
  Seed: MNWRPILTI (TP53 R248W)
MNWRPILTF

SEQ ID NO: 20771 - protein, 9 aa, Artificial Sequence
  Description of Artificial Sequence: Synthetic peptide
  Seed: MNWRPILTI (TP53 R248W)
MNWRPILTH

SEQ ID NO: 20772 - protein, 9 aa, Artificial Sequence
  Description of Artificial Sequence: Synthetic peptide
  Seed: MNWRPILTI (TP53 R248W)
MNWRPILTL

SEQ ID NO: 20773 - protein, 9 aa, Artificial Sequence
  Description of Artificial Sequence: Synthetic peptide
  Seed: MNWRPILTI (TP53 R248W)
MNWRPILTM

SEQ ID NO: 20774 - protein, 9 aa, Artificial Sequence
  Description of Artificial Sequence: Synthetic peptide
  Seed: MNWRPILTI (TP53 R248W)
MNWRPILTV

SEQ ID NO: 20775 - protein, 9 aa, Artificial Sequence
  Description of Artificial Sequence: Synthetic peptide
  Seed: MNWRPILTI (TP53 R248W)
MNWRPILTW

SEQ ID NO: 20776 - protein, 9 aa, Artificial Sequence
  Description of Artificial Sequence: Synthetic peptide
  Seed: MNWRPILTI (TP53 R248W)
MNWRPILTY

SEQ ID NO: 20777 - protein, 9 aa, Artificial Sequence
  Description of Artificial Sequence: Synthetic peptide
  Seed: MNWRPILTI (TP53 R248W)
MPWRPILTF

SEQ ID NO: 20778 - protein, 9 aa, Artificial Sequence
  Description of Artificial Sequence: Synthetic peptide
  Seed: MNWRPILTI (TP53 R248W)
MPWRPILTM

SEQ ID NO: 20779 - protein, 9 aa, Artificial Sequence
  Description of Artificial Sequence: Synthetic peptide
  Seed: MNWRPILTI (TP53 R248W)
MPWRPILTW

SEQ ID NO: 20780 - protein, 9 aa, Artificial Sequence
  Description of Artificial Sequence: Synthetic peptide
  Seed: MNWRPILTI (TP53 R248W)
MPWRPILTY

SEQ ID NO: 20781 - protein, 9 aa, Artificial Sequence
  Description of Artificial Sequence: Synthetic peptide
  Seed: MNWRPILTI (TP53 R248W)
MQWRPILTA

SEQ ID NO: 20782 - protein, 9 aa, Artificial Sequence
  Description of Artificial Sequence: Synthetic peptide
  Seed: MNWRPILTI (TP53 R248W)
MQWRPILTC

SEQ ID NO: 20783 - protein, 9 aa, Artificial Sequence
  Description of Artificial Sequence: Synthetic peptide
  Seed: MNWRPILTI (TP53 R248W)
MQWRPILTE

SEQ ID NO: 20784 - protein, 9 aa, Artificial Sequence
  Description of Artificial Sequence: Synthetic peptide
  Seed: MNWRPILTI (TP53 R248W)
MQWRPILTF

SEQ ID NO: 20785 - protein, 9 aa, Artificial Sequence
  Description of Artificial Sequence: Synthetic peptide
  Seed: MNWRPILTI (TP53 R248W)
MQWRPILTG

SEQ ID NO: 20786 - protein, 9 aa, Artificial Sequence
  Description of Artificial Sequence: Synthetic peptide
  Seed: MNWRPILTI (TP53 R248W)
MQWRPILTH

SEQ ID NO: 20787 - protein, 9 aa, Artificial Sequence
  Description of Artificial Sequence: Synthetic peptide
  Seed: MNWRPILTI (TP53 R248W)
MQWRPILTI

SEQ ID NO: 20788 - protein, 9 aa, Artificial Sequence
  Description of Artificial Sequence: Synthetic peptide
  Seed: MNWRPILTI (TP53 R248W)
MQWRPILTM

SEQ ID NO: 20789 - protein, 9 aa, Artificial Sequence
  Description of Artificial Sequence: Synthetic peptide
  Seed: MNWRPILTI (TP53 R248W)
MQWRPILTN

SEQ ID NO: 20790 - protein, 9 aa, Artificial Sequence
  Description of Artificial Sequence: Synthetic peptide
  Seed: MNWRPILTI (TP53 R248W)
MQWRPILTP

SEQ ID NO: 20791 - protein, 9 aa, Artificial Sequence
  Description of Artificial Sequence: Synthetic peptide
  Seed: MNWRPILTI (TP53 R248W)
MQWRPILTQ

SEQ ID NO: 20792 - protein, 9 aa, Artificial Sequence
  Description of Artificial Sequence: Synthetic peptide
  Seed: MNWRPILTI (TP53 R248W)
MQWRPILTS

SEQ ID NO: 20793 - protein, 9 aa, Artificial Sequence
  Description of Artificial Sequence: Synthetic peptide
  Seed: MNWRPILTI (TP53 R248W)
MQWRPILTT

SEQ ID NO: 20794 - protein, 9 aa, Artificial Sequence
  Description of Artificial Sequence: Synthetic peptide
  Seed: MNWRPILTI (TP53 R248W)
MQWRPILTY

SEQ ID NO: 20795 - protein, 9 aa, Artificial Sequence
  Description of Artificial Sequence: Synthetic peptide
  Seed: MNWRPILTI (TP53 R248W)
MRWRPILTF

SEQ ID NO: 20796 - protein, 9 aa, Artificial Sequence
  Description of Artificial Sequence: Synthetic peptide
  Seed: MNWRPILTI (TP53 R248W)
MRWRPILTH

SEQ ID NO: 20797 - protein, 9 aa, Artificial Sequence
  Description of Artificial Sequence: Synthetic peptide
  Seed: MNWRPILTI (TP53 R248W)
MRWRPILTI

SEQ ID NO: 20798 - protein, 9 aa, Artificial Sequence
  Description of Artificial Sequence: Synthetic peptide
  Seed: MNWRPILTI (TP53 R248W)
MRWRPILTL

SEQ ID NO: 20799 - protein, 9 aa, Artificial Sequence
  Description of Artificial Sequence: Synthetic peptide
  Seed: MNWRPILTI (TP53 R248W)
MRWRPILTV

SEQ ID NO: 20800 - protein, 9 aa, Artificial Sequence
  Description of Artificial Sequence: Synthetic peptide
  Seed: MNWRPILTI (TP53 R248W)
MRWRPILTW

SEQ ID NO: 20801 - protein, 9 aa, Artificial Sequence
  Description of Artificial Sequence: Synthetic peptide
  Seed: MNWRPILTI (TP53 R248W)
MSWRPILTA

SEQ ID NO: 20802 - protein, 9 aa, Artificial Sequence
  Description of Artificial Sequence: Synthetic peptide
  Seed: MNWRPILTI (TP53 R248W)
MSWRPILTC

SEQ ID NO: 20803 - protein, 9 aa, Artificial Sequence
  Description of Artificial Sequence: Synthetic peptide
  Seed: MNWRPILTI (TP53 R248W)
MSWRPILTG

SEQ ID NO: 20804 - protein, 9 aa, Artificial Sequence
  Description of Artificial Sequence: Synthetic peptide
  Seed: MNWRPILTI (TP53 R248W)
MSWRPILTH

SEQ ID NO: 20805 - protein, 9 aa, Artificial Sequence
  Description of Artificial Sequence: Synthetic peptide
  Seed: MNWRPILTI (TP53 R248W)
MSWRPILTI

SEQ ID NO: 20806 - protein, 9 aa, Artificial Sequence
  Description of Artificial Sequence: Synthetic peptide
  Seed: MNWRPILTI (TP53 R248W)
MSWRPILTM

SEQ ID NO: 20807 - protein, 9 aa, Artificial Sequence
  Description of Artificial Sequence: Synthetic peptide
  Seed: MNWRPILTI (TP53 R248W)
MSWRPILTT

SEQ ID NO: 20808 - protein, 9 aa, Artificial Sequence
  Description of Artificial Sequence: Synthetic peptide
  Seed: MNWRPILTI (TP53 R248W)
MSWRPILTW

SEQ ID NO: 20809 - protein, 9 aa, Artificial Sequence
  Description of Artificial Sequence: Synthetic peptide
  Seed: MNWRPILTI (TP53 R248W)
MSWRPILTY

SEQ ID NO: 20810 - protein, 9 aa, Artificial Sequence
  Description of Artificial Sequence: Synthetic peptide
  Seed: MNWRPILTI (TP53 R248W)
MTWRPILTA

SEQ ID NO: 20811 - protein, 9 aa, Artificial Sequence
  Description of Artificial Sequence: Synthetic peptide
  Seed: MNWRPILTI (TP53 R248W)
MTWRPILTC

SEQ ID NO: 20812 - protein, 9 aa, Artificial Sequence
  Description of Artificial Sequence: Synthetic peptide
  Seed: MNWRPILTI (TP53 R248W)
MTWRPILTF

SEQ ID NO: 20813 - protein, 9 aa, Artificial Sequence
  Description of Artificial Sequence: Synthetic peptide
  Seed: MNWRPILTI (TP53 R248W)
MTWRPILTG

SEQ ID NO: 20814 - protein, 9 aa, Artificial Sequence
  Description of Artificial Sequence: Synthetic peptide
  Seed: MNWRPILTI (TP53 R248W)
MTWRPILTH

SEQ ID NO: 20815 - protein, 9 aa, Artificial Sequence
  Description of Artificial Sequence: Synthetic peptide
  Seed: MNWRPILTI (TP53 R248W)
MTWRPILTI

SEQ ID NO: 20816 - protein, 9 aa, Artificial Sequence
  Description of Artificial Sequence: Synthetic peptide
  Seed: MNWRPILTI (TP53 R248W)
MTWRPILTM

SEQ ID NO: 20817 - protein, 9 aa, Artificial Sequence
  Description of Artificial Sequence: Synthetic peptide
  Seed: MNWRPILTI (TP53 R248W)
MTWRPILTW

SEQ ID NO: 20818 - protein, 9 aa, Artificial Sequence
  Description of Artificial Sequence: Synthetic peptide
  Seed: MNWRPILTI (TP53 R248W)
MTWRPILTY

SEQ ID NO: 20819 - protein, 9 aa, Artificial Sequence
  Description of Artificial Sequence: Synthetic peptide
  Seed: MNWRPILTI (TP53 R248W)
MVWRPILTF

SEQ ID NO: 20820 - protein, 9 aa, Artificial Sequence
  Description of Artificial Sequence: Synthetic peptide
  Seed: MNWRPILTI (TP53 R248W)
MVWRPILTH

SEQ ID NO: 20821 - protein, 9 aa, Artificial Sequence
  Description of Artificial Sequence: Synthetic peptide
  Seed: MNWRPILTI (TP53 R248W)
MVWRPILTI

SEQ ID NO: 20822 - protein, 9 aa, Artificial Sequence
  Description of Artificial Sequence: Synthetic peptide
  Seed: MNWRPILTI (TP53 R248W)
MVWRPILTL

SEQ ID NO: 20823 - protein, 9 aa, Artificial Sequence
  Description of Artificial Sequence: Synthetic peptide
  Seed: MNWRPILTI (TP53 R248W)
MVWRPILTM

SEQ ID NO: 20824 - protein, 9 aa, Artificial Sequence
  Description of Artificial Sequence: Synthetic peptide
  Seed: MNWRPILTI (TP53 R248W)
MVWRPILTV

SEQ ID NO: 20825 - protein, 9 aa, Artificial Sequence
  Description of Artificial Sequence: Synthetic peptide
  Seed: MNWRPILTI (TP53 R248W)
MVWRPILTW

SEQ ID NO: 20826 - protein, 9 aa, Artificial Sequence
  Description of Artificial Sequence: Synthetic peptide
  Seed: MNWRPILTI (TP53 R248W)
MWWRPILTF

SEQ ID NO: 20827 - protein, 9 aa, Artificial Sequence
  Description of Artificial Sequence: Synthetic peptide
  Seed: MNWRPILTI (TP53 R248W)
MWWRPILTI

SEQ ID NO: 20828 - protein, 9 aa, Artificial Sequence
  Description of Artificial Sequence: Synthetic peptide
  Seed: MNWRPILTI (TP53 R248W)
MWWRPILTM

SEQ ID NO: 20829 - protein, 9 aa, Artificial Sequence
  Description of Artificial Sequence: Synthetic peptide
  Seed: MNWRPILTI (TP53 R248W)
MWWRPILTW

SEQ ID NO: 20830 - protein, 9 aa, Artificial Sequence
  Description of Artificial Sequence: Synthetic peptide
  Seed: MNWRPILTI (TP53 R248W)
MWWRPILTY

SEQ ID NO: 20831 - protein, 9 aa, Artificial Sequence
  Description of Artificial Sequence: Synthetic peptide
  Seed: MNWRPILTI (TP53 R248W)
MYWRPILTF

SEQ ID NO: 20832 - protein, 9 aa, Artificial Sequence
  Description of Artificial Sequence: Synthetic peptide
  Seed: MNWRPILTI (TP53 R248W)
MYWRPILTH

SEQ ID NO: 20833 - protein, 9 aa, Artificial Sequence
  Description of Artificial Sequence: Synthetic peptide
  Seed: MNWRPILTI (TP53 R248W)
MYWRPILTI

SEQ ID NO: 20834 - protein, 9 aa, Artificial Sequence
  Description of Artificial Sequence: Synthetic peptide
  Seed: MNWRPILTI (TP53 R248W)
MYWRPILTL

SEQ ID NO: 20835 - protein, 9 aa, Artificial Sequence
  Description of Artificial Sequence: Synthetic peptide
  Seed: MNWRPILTI (TP53 R248W)
MYWRPILTM

SEQ ID NO: 20836 - protein, 9 aa, Artificial Sequence
  Description of Artificial Sequence: Synthetic peptide
  Seed: MNWRPILTI (TP53 R248W)
MYWRPILTV

SEQ ID NO: 20837 - protein, 9 aa, Artificial Sequence
  Description of Artificial Sequence: Synthetic peptide
  Seed: MNWRPILTI (TP53 R248W)
MYWRPILTW

SEQ ID NO: 20838 - protein, 9 aa, Artificial Sequence
  Description of Artificial Sequence: Synthetic peptide
  Seed: MNWRPILTI (TP53 R248W)
MYWRPILTY

SEQ ID NO: 20839 - protein, 11 aa, Artificial Sequence
  Description of Artificial Sequence: Synthetic peptide
  Seed: NSSCMGGMNWR (TP53 R248W)
NASCMGGMNWR

SEQ ID NO: 20840 - protein, 11 aa, Artificial Sequence
  Description of Artificial Sequence: Synthetic peptide
  Seed: NSSCMGGMNWR (TP53 R248W)
NFSCMGGMNWR

SEQ ID NO: 20841 - protein, 11 aa, Artificial Sequence
  Description of Artificial Sequence: Synthetic peptide
  Seed: NSSCMGGMNWR (TP53 R248W)
NISCMGGMNWR

SEQ ID NO: 20842 - protein, 11 aa, Artificial Sequence
  Description of Artificial Sequence: Synthetic peptide
  Seed: NSSCMGGMNWR (TP53 R248W)
NKSCMGGMNWR

SEQ ID NO: 20843 - protein, 11 aa, Artificial Sequence
  Description of Artificial Sequence: Synthetic peptide
  Seed: NSSCMGGMNWR (TP53 R248W)
NLSCMGGMNWR

SEQ ID NO: 20844 - protein, 11 aa, Artificial Sequence
  Description of Artificial Sequence: Synthetic peptide
  Seed: NSSCMGGMNWR (TP53 R248W)
NMSCMGGMNWR

SEQ ID NO: 20845 - protein, 11 aa, Artificial Sequence
  Description of Artificial Sequence: Synthetic peptide
  Seed: NSSCMGGMNWR (TP53 R248W)
NRSCMGGMNWR

SEQ ID NO: 20846 - protein, 11 aa, Artificial Sequence
  Description of Artificial Sequence: Synthetic peptide
  Seed: NSSCMGGMNWR (TP53 R248W)
NSSCMGGMNWK

SEQ ID NO: 20847 - protein, 11 aa, Artificial Sequence
  Description of Artificial Sequence: Synthetic peptide
  Seed: NSSCMGGMNWR (TP53 R248W)
NTSCMGGMNWK

SEQ ID NO: 20848 - protein, 11 aa, Artificial Sequence
  Description of Artificial Sequence: Synthetic peptide
  Seed: NSSCMGGMNWR (TP53 R248W)
NTSCMGGMNWR

SEQ ID NO: 20849 - protein, 11 aa, Artificial Sequence
  Description of Artificial Sequence: Synthetic peptide
  Seed: NSSCMGGMNWR (TP53 R248W)
NVSCMGGMNWK

SEQ ID NO: 20850 - protein, 11 aa, Artificial Sequence
  Description of Artificial Sequence: Synthetic peptide
  Seed: NSSCMGGMNWR (TP53 R248W)
NVSCMGGMNWR

SEQ ID NO: 20851 - protein, 11 aa, Artificial Sequence
  Description of Artificial Sequence: Synthetic peptide
  Seed: NSSCMGGMNWR (TP53 R248W)
NYSCMGGMNWR

SEQ ID NO: 20852 - protein, 10 aa, Artificial Sequence
  Description of Artificial Sequence: Synthetic peptide
  Seed: SSCMGGMNWR (TP53 R248W)
SACMGGMNWK

SEQ ID NO: 20853 - protein, 10 aa, Artificial Sequence
  Description of Artificial Sequence: Synthetic peptide
  Seed: SSCMGGMNWR (TP53 R248W)
SACMGGMNWR

SEQ ID NO: 20854 - protein, 9 aa, Artificial Sequence
  Description of Artificial Sequence: Synthetic peptide
  Seed: SCMGGMNWR (TP53 R248W)
SAMGGMNWK

SEQ ID NO: 20855 - protein, 10 aa, Artificial Sequence
  Description of Artificial Sequence: Synthetic peptide
  Seed: SSCMGGMNWR (TP53 R248W)
SCCMGGMNWR

SEQ ID NO: 20856 - protein, 10 aa, Artificial Sequence
  Description of Artificial Sequence: Synthetic peptide
  Seed: SSCMGGMNWR (TP53 R248W)
SECMGGMNWR

SEQ ID NO: 20857 - protein, 10 aa, Artificial Sequence
  Description of Artificial Sequence: Synthetic peptide
  Seed: SSCMGGMNWR (TP53 R248W)
SFCMGGMNWK

SEQ ID NO: 20858 - protein, 10 aa, Artificial Sequence
  Description of Artificial Sequence: Synthetic peptide
  Seed: SSCMGGMNWR (TP53 R248W)
SFCMGGMNWR

SEQ ID NO: 20859 - protein, 9 aa, Artificial Sequence
  Description of Artificial Sequence: Synthetic peptide
  Seed: SCMGGMNWR (TP53 R248W)
SFMGGMNWK

SEQ ID NO: 20860 - protein, 9 aa, Artificial Sequence
  Description of Artificial Sequence: Synthetic peptide
  Seed: SCMGGMNWR (TP53 R248W)
SFMGGMNWR

SEQ ID NO: 20861 - protein, 10 aa, Artificial Sequence
  Description of Artificial Sequence: Synthetic peptide
  Seed: SSCMGGMNWR (TP53 R248W)
SGCMGGMNWK

SEQ ID NO: 20862 - protein, 10 aa, Artificial Sequence
  Description of Artificial Sequence: Synthetic peptide
  Seed: SSCMGGMNWR (TP53 R248W)
SGCMGGMNWR

SEQ ID NO: 20863 - protein, 9 aa, Artificial Sequence
  Description of Artificial Sequence: Synthetic peptide
  Seed: SCMGGMNWR (TP53 R248W)
SGMGGMNWK

SEQ ID NO: 20864 - protein, 9 aa, Artificial Sequence
  Description of Artificial Sequence: Synthetic peptide
  Seed: SCMGGMNWR (TP53 R248W)
SGMGGMNWR

SEQ ID NO: 20865 - protein, 10 aa, Artificial Sequence
  Description of Artificial Sequence: Synthetic peptide
  Seed: SSCMGGMNWR (TP53 R248W)
SHCMGGMNWR

SEQ ID NO: 20866 - protein, 9 aa, Artificial Sequence
  Description of Artificial Sequence: Synthetic peptide
  Seed: SCMGGMNWR (TP53 R248W)
SHMGGMNWR

SEQ ID NO: 20867 - protein, 10 aa, Artificial Sequence
  Description of Artificial Sequence: Synthetic peptide
  Seed: SSCMGGMNWR (TP53 R248W)
SICMGGMNWK

SEQ ID NO: 20868 - protein, 10 aa, Artificial Sequence
  Description of Artificial Sequence: Synthetic peptide
  Seed: SSCMGGMNWR (TP53 R248W)
SICMGGMNWR

SEQ ID NO: 20869 - protein, 10 aa, Artificial Sequence
  Description of Artificial Sequence: Synthetic peptide
  Seed: SSCMGGMNWR (TP53 R248W)
SICMGGMNWY

SEQ ID NO: 20870 - protein, 9 aa, Artificial Sequence
  Description of Artificial Sequence: Synthetic peptide
  Seed: SCMGGMNWR (TP53 R248W)
SIMGGMNWK

SEQ ID NO: 20871 - protein, 9 aa, Artificial Sequence
  Description of Artificial Sequence: Synthetic peptide
  Seed: SCMGGMNWR (TP53 R248W)
SIMGGMNWR

SEQ ID NO: 20872 - protein, 10 aa, Artificial Sequence
  Description of Artificial Sequence: Synthetic peptide
  Seed: SSCMGGMNWR (TP53 R248W)
SKCMGGMNWR

SEQ ID NO: 20873 - protein, 9 aa, Artificial Sequence
  Description of Artificial Sequence: Synthetic peptide
  Seed: SCMGGMNWR (TP53 R248W)
SKMGGMNWR

SEQ ID NO: 20874 - protein, 10 aa, Artificial Sequence
  Description of Artificial Sequence: Synthetic peptide
  Seed: SSCMGGMNWR (TP53 R248W)
SLCMGGMNWK

SEQ ID NO: 20875 - protein, 10 aa, Artificial Sequence
  Description of Artificial Sequence: Synthetic peptide
  Seed: SSCMGGMNWR (TP53 R248W)
SLCMGGMNWR

SEQ ID NO: 20876 - protein, 9 aa, Artificial Sequence
  Description of Artificial Sequence: Synthetic peptide
  Seed: SCMGGMNWR (TP53 R248W)
SLMGGMNWK

SEQ ID NO: 20877 - protein, 9 aa, Artificial Sequence
  Description of Artificial Sequence: Synthetic peptide
  Seed: SCMGGMNWR (TP53 R248W)
SLMGGMNWR

SEQ ID NO: 20878 - protein, 10 aa, Artificial Sequence
  Description of Artificial Sequence: Synthetic peptide
  Seed: SSCMGGMNWR (TP53 R248W)
SMCMGGMNWK

SEQ ID NO: 20879 - protein, 10 aa, Artificial Sequence
  Description of Artificial Sequence: Synthetic peptide
  Seed: SSCMGGMNWR (TP53 R248W)
SMCMGGMNWR

SEQ ID NO: 20880 - protein, 9 aa, Artificial Sequence
  Description of Artificial Sequence: Synthetic peptide
  Seed: SCMGGMNWR (TP53 R248W)
SMMGGMNWH

SEQ ID NO: 20881 - protein, 9 aa, Artificial Sequence
  Description of Artificial Sequence: Synthetic peptide
  Seed: SCMGGMNWR (TP53 R248W)
SMMGGMNWK

SEQ ID NO: 20882 - protein, 9 aa, Artificial Sequence
  Description of Artificial Sequence: Synthetic peptide
  Seed: SCMGGMNWR (TP53 R248W)
SMMGGMNWR

SEQ ID NO: 20883 - protein, 10 aa, Artificial Sequence
  Description of Artificial Sequence: Synthetic peptide
  Seed: SSCMGGMNWR (TP53 R248W)
SNCMGGMNWR

SEQ ID NO: 20884 - protein, 9 aa, Artificial Sequence
  Description of Artificial Sequence: Synthetic peptide
  Seed: SCMGGMNWR (TP53 R248W)
SNMGGMNWK

SEQ ID NO: 20885 - protein, 9 aa, Artificial Sequence
  Description of Artificial Sequence: Synthetic peptide
  Seed: SCMGGMNWR (TP53 R248W)
SNMGGMNWR

SEQ ID NO: 20886 - protein, 9 aa, Artificial Sequence
  Description of Artificial Sequence: Synthetic peptide
  Seed: SCMGGMNWR (TP53 R248W)
SPMGGMNWR

SEQ ID NO: 20887 - protein, 10 aa, Artificial Sequence
  Description of Artificial Sequence: Synthetic peptide
  Seed: SSCMGGMNWR (TP53 R248W)
SQCMGGMNWK

SEQ ID NO: 20888 - protein, 10 aa, Artificial Sequence
  Description of Artificial Sequence: Synthetic peptide
  Seed: SSCMGGMNWR (TP53 R248W)
SQCMGGMNWR

SEQ ID NO: 20889 - protein, 9 aa, Artificial Sequence
  Description of Artificial Sequence: Synthetic peptide
  Seed: SCMGGMNWR (TP53 R248W)
SQMGGMNWK

SEQ ID NO: 20890 - protein, 9 aa, Artificial Sequence
  Description of Artificial Sequence: Synthetic peptide
  Seed: SCMGGMNWR (TP53 R248W)
SQMGGMNWR

SEQ ID NO: 20891 - protein, 10 aa, Artificial Sequence
  Description of Artificial Sequence: Synthetic peptide
  Seed: SSCMGGMNWR (TP53 R248W)
SRCMGGMNWR

SEQ ID NO: 20892 - protein, 10 aa, Artificial Sequence
  Description of Artificial Sequence: Synthetic peptide
  Seed: SSCMGGMNWR (TP53 R248W)
SSCMGGMNWK

SEQ ID NO: 20893 - protein, 10 aa, Artificial Sequence
  Description of Artificial Sequence: Synthetic peptide
  Seed: SSCMGGMNWR (TP53 R248W)
SSCMGGMNWY

SEQ ID NO: 20894 - protein, 9 aa, Artificial Sequence
  Description of Artificial Sequence: Synthetic peptide
  Seed: SCMGGMNWR (TP53 R248W)
SSMGGMNWK

SEQ ID NO: 20895 - protein, 9 aa, Artificial Sequence
  Description of Artificial Sequence: Synthetic peptide
  Seed: SCMGGMNWR (TP53 R248W)
SSMGGMNWY

SEQ ID NO: 20896 - protein, 10 aa, Artificial Sequence
  Description of Artificial Sequence: Synthetic peptide
  Seed: SSCMGGMNWR (TP53 R248W)
STCMGGMNWR

SEQ ID NO: 20897 - protein, 10 aa, Artificial Sequence
  Description of Artificial Sequence: Synthetic peptide
  Seed: SSCMGGMNWR (TP53 R248W)
STCMGGMNWY

SEQ ID NO: 20898 - protein, 9 aa, Artificial Sequence
  Description of Artificial Sequence: Synthetic peptide
  Seed: SCMGGMNWR (TP53 R248W)
STMGGMNWH

SEQ ID NO: 20899 - protein, 9 aa, Artificial Sequence
  Description of Artificial Sequence: Synthetic peptide
  Seed: SCMGGMNWR (TP53 R248W)
STMGGMNWK

SEQ ID NO: 20900 - protein, 9 aa, Artificial Sequence
  Description of Artificial Sequence: Synthetic peptide
  Seed: SCMGGMNWR (TP53 R248W)
STMGGMNWY

SEQ ID NO: 20901 - protein, 10 aa, Artificial Sequence
  Description of Artificial Sequence: Synthetic peptide
  Seed: SSCMGGMNWR (TP53 R248W)
SVCMGGMNWR

SEQ ID NO: 20902 - protein, 10 aa, Artificial Sequence
  Description of Artificial Sequence: Synthetic peptide
  Seed: SSCMGGMNWR (TP53 R248W)
SVCMGGMNWY

SEQ ID NO: 20903 - protein, 9 aa, Artificial Sequence
  Description of Artificial Sequence: Synthetic peptide
  Seed: SCMGGMNWR (TP53 R248W)
SVMGGMNWK

SEQ ID NO: 20904 - protein, 9 aa, Artificial Sequence
  Description of Artificial Sequence: Synthetic peptide
  Seed: SCMGGMNWR (TP53 R248W)
SVMGGMNWY

SEQ ID NO: 20905 - protein, 10 aa, Artificial Sequence
  Description of Artificial Sequence: Synthetic peptide
  Seed: SSCMGGMNWR (TP53 R248W)
SWCMGGMNWK

SEQ ID NO: 20906 - protein, 10 aa, Artificial Sequence
  Description of Artificial Sequence: Synthetic peptide
  Seed: SSCMGGMNWR (TP53 R248W)
SWCMGGMNWR

SEQ ID NO: 20907 - protein, 9 aa, Artificial Sequence
  Description of Artificial Sequence: Synthetic peptide
  Seed: SCMGGMNWR (TP53 R248W)
SWMGGMNWK

SEQ ID NO: 20908 - protein, 9 aa, Artificial Sequence
  Description of Artificial Sequence: Synthetic peptide
  Seed: SCMGGMNWR (TP53 R248W)
SWMGGMNWR

SEQ ID NO: 20909 - protein, 10 aa, Artificial Sequence
  Description of Artificial Sequence: Synthetic peptide
  Seed: SSCMGGMNWR (TP53 R248W)
SYCMGGMNWK

SEQ ID NO: 20910 - protein, 10 aa, Artificial Sequence
  Description of Artificial Sequence: Synthetic peptide
  Seed: SSCMGGMNWR (TP53 R248W)
SYCMGGMNWR

SEQ ID NO: 20911 - protein, 9 aa, Artificial Sequence
  Description of Artificial Sequence: Synthetic peptide
  Seed: SCMGGMNWR (TP53 R248W)
SYMGGMNWK

SEQ ID NO: 20912 - protein, 9 aa, Artificial Sequence
  Description of Artificial Sequence: Synthetic peptide
  Seed: SCMGGMNWR (TP53 R248W)
SYMGGMNWR

SEQ ID NO: 20913 - protein, 10 aa, Artificial Sequence
  Description of Artificial Sequence: Synthetic peptide
  Seed: WRPILTIITL (TP53 R248W)
WAPILTIITA

SEQ ID NO: 20914 - protein, 10 aa, Artificial Sequence
  Description of Artificial Sequence: Synthetic peptide
  Seed: WRPILTIITL (TP53 R248W)
WAPILTIITF

SEQ ID NO: 20915 - protein, 10 aa, Artificial Sequence
  Description of Artificial Sequence: Synthetic peptide
  Seed: WRPILTIITL (TP53 R248W)
WAPILTIITI

SEQ ID NO: 20916 - protein, 10 aa, Artificial Sequence
  Description of Artificial Sequence: Synthetic peptide
  Seed: WRPILTIITL (TP53 R248W)
WAPILTIITL

SEQ ID NO: 20917 - protein, 10 aa, Artificial Sequence
  Description of Artificial Sequence: Synthetic peptide
  Seed: WRPILTIITL (TP53 R248W)
WAPILTIITM

SEQ ID NO: 20918 - protein, 10 aa, Artificial Sequence
  Description of Artificial Sequence: Synthetic peptide
  Seed: WRPILTIITL (TP53 R248W)
WAPILTIITV

SEQ ID NO: 20919 - protein, 10 aa, Artificial Sequence
  Description of Artificial Sequence: Synthetic peptide
  Seed: WRPILTIITL (TP53 R248W)
WAPILTIITY

SEQ ID NO: 20920 - protein, 10 aa, Artificial Sequence
  Description of Artificial Sequence: Synthetic peptide
  Seed: WRPILTIITL (TP53 R248W)
WCPILTIITA

SEQ ID NO: 20921 - protein, 10 aa, Artificial Sequence
  Description of Artificial Sequence: Synthetic peptide
  Seed: WRPILTIITL (TP53 R248W)
WCPILTIITF

SEQ ID NO: 20922 - protein, 10 aa, Artificial Sequence
  Description of Artificial Sequence: Synthetic peptide
  Seed: WRPILTIITL (TP53 R248W)
WCPILTIITI

SEQ ID NO: 20923 - protein, 10 aa, Artificial Sequence
  Description of Artificial Sequence: Synthetic peptide
  Seed: WRPILTIITL (TP53 R248W)
WCPILTIITL

SEQ ID NO: 20924 - protein, 10 aa, Artificial Sequence
  Description of Artificial Sequence: Synthetic peptide
  Seed: WRPILTIITL (TP53 R248W)
WCPILTIITM

SEQ ID NO: 20925 - protein, 10 aa, Artificial Sequence
  Description of Artificial Sequence: Synthetic peptide
  Seed: WRPILTIITL (TP53 R248W)
WCPILTIITV

SEQ ID NO: 20926 - protein, 10 aa, Artificial Sequence
  Description of Artificial Sequence: Synthetic peptide
  Seed: WRPILTIITL (TP53 R248W)
WCPILTIITY

SEQ ID NO: 20927 - protein, 10 aa, Artificial Sequence
  Description of Artificial Sequence: Synthetic peptide
  Seed: WRPILTIITL (TP53 R248W)
WDPILTIITA

SEQ ID NO: 20928 - protein, 10 aa, Artificial Sequence
  Description of Artificial Sequence: Synthetic peptide
  Seed: WRPILTIITL (TP53 R248W)
WDPILTIITF

SEQ ID NO: 20929 - protein, 10 aa, Artificial Sequence
  Description of Artificial Sequence: Synthetic peptide
  Seed: WRPILTIITL (TP53 R248W)
WDPILTIITI

SEQ ID NO: 20930 - protein, 10 aa, Artificial Sequence
  Description of Artificial Sequence: Synthetic peptide
  Seed: WRPILTIITL (TP53 R248W)
WDPILTIITL

SEQ ID NO: 20931 - protein, 10 aa, Artificial Sequence
  Description of Artificial Sequence: Synthetic peptide
  Seed: WRPILTIITL (TP53 R248W)
WDPILTIITM

SEQ ID NO: 20932 - protein, 10 aa, Artificial Sequence
  Description of Artificial Sequence: Synthetic peptide
  Seed: WRPILTIITL (TP53 R248W)
WDPILTIITV

SEQ ID NO: 20933 - protein, 10 aa, Artificial Sequence
  Description of Artificial Sequence: Synthetic peptide
  Seed: WRPILTIITL (TP53 R248W)
WDPILTIITY

SEQ ID NO: 20934 - protein, 10 aa, Artificial Sequence
  Description of Artificial Sequence: Synthetic peptide
  Seed: WRPILTIITL (TP53 R248W)
WEPILTIITA

SEQ ID NO: 20935 - protein, 10 aa, Artificial Sequence
  Description of Artificial Sequence: Synthetic peptide
  Seed: WRPILTIITL (TP53 R248W)
WEPILTIITF

SEQ ID NO: 20936 - protein, 10 aa, Artificial Sequence
  Description of Artificial Sequence: Synthetic peptide
  Seed: WRPILTIITL (TP53 R248W)
WEPILTIITI

SEQ ID NO: 20937 - protein, 10 aa, Artificial Sequence
  Description of Artificial Sequence: Synthetic peptide
  Seed: WRPILTIITL (TP53 R248W)
WEPILTIITL

SEQ ID NO: 20938 - protein, 10 aa, Artificial Sequence
  Description of Artificial Sequence: Synthetic peptide
  Seed: WRPILTIITL (TP53 R248W)
WEPILTIITM

SEQ ID NO: 20939 - protein, 10 aa, Artificial Sequence
  Description of Artificial Sequence: Synthetic peptide
  Seed: WRPILTIITL (TP53 R248W)
WEPILTIITV

SEQ ID NO: 20940 - protein, 10 aa, Artificial Sequence
  Description of Artificial Sequence: Synthetic peptide
  Seed: WRPILTIITL (TP53 R248W)
WEPILTIITY

SEQ ID NO: 20941 - protein, 10 aa, Artificial Sequence
  Description of Artificial Sequence: Synthetic peptide
  Seed: WRPILTIITL (TP53 R248W)
WFPILTIITA

SEQ ID NO: 20942 - protein, 10 aa, Artificial Sequence
  Description of Artificial Sequence: Synthetic peptide
  Seed: WRPILTIITL (TP53 R248W)
WFPILTIITF

SEQ ID NO: 20943 - protein, 10 aa, Artificial Sequence
  Description of Artificial Sequence: Synthetic peptide
  Seed: WRPILTIITL (TP53 R248W)
WFPILTIITI

SEQ ID NO: 20944 - protein, 10 aa, Artificial Sequence
  Description of Artificial Sequence: Synthetic peptide
  Seed: WRPILTIITL (TP53 R248W)
WFPILTIITL

SEQ ID NO: 20945 - protein, 10 aa, Artificial Sequence
  Description of Artificial Sequence: Synthetic peptide
  Seed: WRPILTIITL (TP53 R248W)
WFPILTIITM

SEQ ID NO: 20946 - protein, 10 aa, Artificial Sequence
  Description of Artificial Sequence: Synthetic peptide
  Seed: WRPILTIITL (TP53 R248W)
WFPILTIITV

SEQ ID NO: 20947 - protein, 10 aa, Artificial Sequence
  Description of Artificial Sequence: Synthetic peptide
  Seed: WRPILTIITL (TP53 R248W)
WFPILTIITY

SEQ ID NO: 20948 - protein, 10 aa, Artificial Sequence
  Description of Artificial Sequence: Synthetic peptide
  Seed: WRPILTIITL (TP53 R248W)
WGPILTIITA

SEQ ID NO: 20949 - protein, 10 aa, Artificial Sequence
  Description of Artificial Sequence: Synthetic peptide
  Seed: WRPILTIITL (TP53 R248W)
WGPILTIITF

SEQ ID NO: 20950 - protein, 10 aa, Artificial Sequence
  Description of Artificial Sequence: Synthetic peptide
  Seed: WRPILTIITL (TP53 R248W)
WGPILTIITI

SEQ ID NO: 20951 - protein, 10 aa, Artificial Sequence
  Description of Artificial Sequence: Synthetic peptide
  Seed: WRPILTIITL (TP53 R248W)
WGPILTIITL

SEQ ID NO: 20952 - protein, 10 aa, Artificial Sequence
  Description of Artificial Sequence: Synthetic peptide
  Seed: WRPILTIITL (TP53 R248W)
WGPILTIITM

SEQ ID NO: 20953 - protein, 10 aa, Artificial Sequence
  Description of Artificial Sequence: Synthetic peptide
  Seed: WRPILTIITL (TP53 R248W)
WGPILTIITV

SEQ ID NO: 20954 - protein, 10 aa, Artificial Sequence
  Description of Artificial Sequence: Synthetic peptide
  Seed: WRPILTIITL (TP53 R248W)
WGPILTIITY

SEQ ID NO: 20955 - protein, 10 aa, Artificial Sequence
  Description of Artificial Sequence: Synthetic peptide
  Seed: WRPILTIITL (TP53 R248W)
WHPILTIITA

SEQ ID NO: 20956 - protein, 10 aa, Artificial Sequence
  Description of Artificial Sequence: Synthetic peptide
  Seed: WRPILTIITL (TP53 R248W)
WHPILTIITF

SEQ ID NO: 20957 - protein, 10 aa, Artificial Sequence
  Description of Artificial Sequence: Synthetic peptide
  Seed: WRPILTIITL (TP53 R248W)
WHPILTIITI

SEQ ID NO: 20958 - protein, 10 aa, Artificial Sequence
  Description of Artificial Sequence: Synthetic peptide
  Seed: WRPILTIITL (TP53 R248W)
WHPILTIITL

SEQ ID NO: 20959 - protein, 10 aa, Artificial Sequence
  Description of Artificial Sequence: Synthetic peptide
  Seed: WRPILTIITL (TP53 R248W)
WHPILTIITM

SEQ ID NO: 20960 - protein, 10 aa, Artificial Sequence
  Description of Artificial Sequence: Synthetic peptide
  Seed: WRPILTIITL (TP53 R248W)
WHPILTIITV

SEQ ID NO: 20961 - protein, 10 aa, Artificial Sequence
  Description of Artificial Sequence: Synthetic peptide
  Seed: WRPILTIITL (TP53 R248W)
WHPILTIITY

SEQ ID NO: 20962 - protein, 10 aa, Artificial Sequence
  Description of Artificial Sequence: Synthetic peptide
  Seed: WRPILTIITL (TP53 R248W)
WIPILTIITA

SEQ ID NO: 20963 - protein, 10 aa, Artificial Sequence
  Description of Artificial Sequence: Synthetic peptide
  Seed: WRPILTIITL (TP53 R248W)
WIPILTIITF

SEQ ID NO: 20964 - protein, 10 aa, Artificial Sequence
  Description of Artificial Sequence: Synthetic peptide
  Seed: WRPILTIITL (TP53 R248W)
WIPILTIITI

SEQ ID NO: 20965 - protein, 10 aa, Artificial Sequence
  Description of Artificial Sequence: Synthetic peptide
  Seed: WRPILTIITL (TP53 R248W)
WIPILTIITL

SEQ ID NO: 20966 - protein, 10 aa, Artificial Sequence
  Description of Artificial Sequence: Synthetic peptide
  Seed: WRPILTIITL (TP53 R248W)
WIPILTIITM

SEQ ID NO: 20967 - protein, 10 aa, Artificial Sequence
  Description of Artificial Sequence: Synthetic peptide
  Seed: WRPILTIITL (TP53 R248W)
WIPILTIITV

SEQ ID NO: 20968 - protein, 10 aa, Artificial Sequence
  Description of Artificial Sequence: Synthetic peptide
  Seed: WRPILTIITL (TP53 R248W)
WIPILTIITY

SEQ ID NO: 20969 - protein, 10 aa, Artificial Sequence
  Description of Artificial Sequence: Synthetic peptide
  Seed: WRPILTIITL (TP53 R248W)
WKPILTIITA

SEQ ID NO: 20970 - protein, 10 aa, Artificial Sequence
  Description of Artificial Sequence: Synthetic peptide
  Seed: WRPILTIITL (TP53 R248W)
WKPILTIITF

SEQ ID NO: 20971 - protein, 10 aa, Artificial Sequence
  Description of Artificial Sequence: Synthetic peptide
  Seed: WRPILTIITL (TP53 R248W)
WKPILTIITI

SEQ ID NO: 20972 - protein, 10 aa, Artificial Sequence
  Description of Artificial Sequence: Synthetic peptide
  Seed: WRPILTIITL (TP53 R248W)
WKPILTIITL

SEQ ID NO: 20973 - protein, 10 aa, Artificial Sequence
  Description of Artificial Sequence: Synthetic peptide
  Seed: WRPILTIITL (TP53 R248W)
WKPILTIITM

SEQ ID NO: 20974 - protein, 10 aa, Artificial Sequence
  Description of Artificial Sequence: Synthetic peptide
  Seed: WRPILTIITL (TP53 R248W)
WKPILTIITV

SEQ ID NO: 20975 - protein, 10 aa, Artificial Sequence
  Description of Artificial Sequence: Synthetic peptide
  Seed: WRPILTIITL (TP53 R248W)
WKPILTIITY

SEQ ID NO: 20976 - protein, 10 aa, Artificial Sequence
  Description of Artificial Sequence: Synthetic peptide
  Seed: WRPILTIITL (TP53 R248W)
WLPILTIITA

SEQ ID NO: 20977 - protein, 10 aa, Artificial Sequence
  Description of Artificial Sequence: Synthetic peptide
  Seed: WRPILTIITL (TP53 R248W)
WLPILTIITF

SEQ ID NO: 20978 - protein, 10 aa, Artificial Sequence
  Description of Artificial Sequence: Synthetic peptide
  Seed: WRPILTIITL (TP53 R248W)
WLPILTIITI

SEQ ID NO: 20979 - protein, 10 aa, Artificial Sequence
  Description of Artificial Sequence: Synthetic peptide
  Seed: WRPILTIITL (TP53 R248W)
WLPILTIITL

SEQ ID NO: 20980 - protein, 10 aa, Artificial Sequence
  Description of Artificial Sequence: Synthetic peptide
  Seed: WRPILTIITL (TP53 R248W)
WLPILTIITM

SEQ ID NO: 20981 - protein, 10 aa, Artificial Sequence
  Description of Artificial Sequence: Synthetic peptide
  Seed: WRPILTIITL (TP53 R248W)
WLPILTIITV

SEQ ID NO: 20982 - protein, 10 aa, Artificial Sequence
  Description of Artificial Sequence: Synthetic peptide
  Seed: WRPILTIITL (TP53 R248W)
WLPILTIITY

SEQ ID NO: 20983 - protein, 10 aa, Artificial Sequence
  Description of Artificial Sequence: Synthetic peptide
  Seed: WRPILTIITL (TP53 R248W)
WMPILTIITA

SEQ ID NO: 20984 - protein, 10 aa, Artificial Sequence
  Description of Artificial Sequence: Synthetic peptide
  Seed: WRPILTIITL (TP53 R248W)
WMPILTIITF

SEQ ID NO: 20985 - protein, 10 aa, Artificial Sequence
  Description of Artificial Sequence: Synthetic peptide
  Seed: WRPILTIITL (TP53 R248W)
WMPILTIITH

SEQ ID NO: 20986 - protein, 10 aa, Artificial Sequence
  Description of Artificial Sequence: Synthetic peptide
  Seed: WRPILTIITL (TP53 R248W)
WMPILTIITI

SEQ ID NO: 20987 - protein, 10 aa, Artificial Sequence
  Description of Artificial Sequence: Synthetic peptide
  Seed: WRPILTIITL (TP53 R248W)
WMPILTIITL

SEQ ID NO: 20988 - protein, 10 aa, Artificial Sequence
  Description of Artificial Sequence: Synthetic peptide
  Seed: WRPILTIITL (TP53 R248W)
WMPILTIITM

SEQ ID NO: 20989 - protein, 10 aa, Artificial Sequence
  Description of Artificial Sequence: Synthetic peptide
  Seed: WRPILTIITL (TP53 R248W)
WMPILTIITV

SEQ ID NO: 20990 - protein, 10 aa, Artificial Sequence
  Description of Artificial Sequence: Synthetic peptide
  Seed: WRPILTIITL (TP53 R248W)
WMPILTIITY

SEQ ID NO: 20991 - protein, 10 aa, Artificial Sequence
  Description of Artificial Sequence: Synthetic peptide
  Seed: WRPILTIITL (TP53 R248W)
WNPILTIITA

SEQ ID NO: 20992 - protein, 10 aa, Artificial Sequence
  Description of Artificial Sequence: Synthetic peptide
  Seed: WRPILTIITL (TP53 R248W)
WNPILTIITF

SEQ ID NO: 20993 - protein, 10 aa, Artificial Sequence
  Description of Artificial Sequence: Synthetic peptide
  Seed: WRPILTIITL (TP53 R248W)
WNPILTIITI

SEQ ID NO: 20994 - protein, 10 aa, Artificial Sequence
  Description of Artificial Sequence: Synthetic peptide
  Seed: WRPILTIITL (TP53 R248W)
WNPILTIITL

SEQ ID NO: 20995 - protein, 10 aa, Artificial Sequence
  Description of Artificial Sequence: Synthetic peptide
  Seed: WRPILTIITL (TP53 R248W)
WNPILTIITM

SEQ ID NO: 20996 - protein, 10 aa, Artificial Sequence
  Description of Artificial Sequence: Synthetic peptide
  Seed: WRPILTIITL (TP53 R248W)
WNPILTIITV

SEQ ID NO: 20997 - protein, 10 aa, Artificial Sequence
  Description of Artificial Sequence: Synthetic peptide
  Seed: WRPILTIITL (TP53 R248W)
WNPILTIITY

SEQ ID NO: 20998 - protein, 10 aa, Artificial Sequence
  Description of Artificial Sequence: Synthetic peptide
  Seed: WRPILTIITL (TP53 R248W)
WPPILTIITA

SEQ ID NO: 20999 - protein, 10 aa, Artificial Sequence
  Description of Artificial Sequence: Synthetic peptide
  Seed: WRPILTIITL (TP53 R248W)
WPPILTIITF

SEQ ID NO: 21000 - protein, 10 aa, Artificial Sequence
  Description of Artificial Sequence: Synthetic peptide
  Seed: WRPILTIITL (TP53 R248W)
WPPILTIITI

SEQ ID NO: 21001 - protein, 10 aa, Artificial Sequence
  Description of Artificial Sequence: Synthetic peptide
  Seed: WRPILTIITL (TP53 R248W)
WPPILTIITL

SEQ ID NO: 21002 - protein, 10 aa, Artificial Sequence
  Description of Artificial Sequence: Synthetic peptide
  Seed: WRPILTIITL (TP53 R248W)
WPPILTIITM

SEQ ID NO: 21003 - protein, 10 aa, Artificial Sequence
  Description of Artificial Sequence: Synthetic peptide
  Seed: WRPILTIITL (TP53 R248W)
WPPILTIITV

SEQ ID NO: 21004 - protein, 10 aa, Artificial Sequence
  Description of Artificial Sequence: Synthetic peptide
  Seed: WRPILTIITL (TP53 R248W)
WPPILTIITY

SEQ ID NO: 21005 - protein, 10 aa, Artificial Sequence
  Description of Artificial Sequence: Synthetic peptide
  Seed: WRPILTIITL (TP53 R248W)
WQPILTIITA

SEQ ID NO: 21006 - protein, 10 aa, Artificial Sequence
  Description of Artificial Sequence: Synthetic peptide
  Seed: WRPILTIITL (TP53 R248W)
WQPILTIITF

SEQ ID NO: 21007 - protein, 10 aa, Artificial Sequence
  Description of Artificial Sequence: Synthetic peptide
  Seed: WRPILTIITL (TP53 R248W)
WQPILTIITI

SEQ ID NO: 21008 - protein, 10 aa, Artificial Sequence
  Description of Artificial Sequence: Synthetic peptide
  Seed: WRPILTIITL (TP53 R248W)
WQPILTIITL

SEQ ID NO: 21009 - protein, 10 aa, Artificial Sequence
  Description of Artificial Sequence: Synthetic peptide
  Seed: WRPILTIITL (TP53 R248W)
WQPILTIITM

SEQ ID NO: 21010 - protein, 10 aa, Artificial Sequence
  Description of Artificial Sequence: Synthetic peptide
  Seed: WRPILTIITL (TP53 R248W)
WQPILTIITV

SEQ ID NO: 21011 - protein, 10 aa, Artificial Sequence
  Description of Artificial Sequence: Synthetic peptide
  Seed: WRPILTIITL (TP53 R248W)
WQPILTIITY

SEQ ID NO: 21012 - protein, 10 aa, Artificial Sequence
  Description of Artificial Sequence: Synthetic peptide
  Seed: WRPILTIITL (TP53 R248W)
WRPILTIITA

SEQ ID NO: 21013 - protein, 10 aa, Artificial Sequence
  Description of Artificial Sequence: Synthetic peptide
  Seed: WRPILTIITL (TP53 R248W)
WRPILTIITF

SEQ ID NO: 21014 - protein, 10 aa, Artificial Sequence
  Description of Artificial Sequence: Synthetic peptide
  Seed: WRPILTIITL (TP53 R248W)
WRPILTIITI

SEQ ID NO: 21015 - protein, 10 aa, Artificial Sequence
  Description of Artificial Sequence: Synthetic peptide
  Seed: WRPILTIITL (TP53 R248W)
WRPILTIITK

SEQ ID NO: 21016 - protein, 10 aa, Artificial Sequence
  Description of Artificial Sequence: Synthetic peptide
  Seed: WRPILTIITL (TP53 R248W)
WRPILTIITM

SEQ ID NO: 21017 - protein, 10 aa, Artificial Sequence
  Description of Artificial Sequence: Synthetic peptide
  Seed: WRPILTIITL (TP53 R248W)
WRPILTIITR

SEQ ID NO: 21018 - protein, 10 aa, Artificial Sequence
  Description of Artificial Sequence: Synthetic peptide
  Seed: WRPILTIITL (TP53 R248W)
WRPILTIITV

SEQ ID NO: 21019 - protein, 10 aa, Artificial Sequence
  Description of Artificial Sequence: Synthetic peptide
  Seed: WRPILTIITL (TP53 R248W)
WRPILTIITY

SEQ ID NO: 21020 - protein, 10 aa, Artificial Sequence
  Description of Artificial Sequence: Synthetic peptide
  Seed: WRPILTIITL (TP53 R248W)
WSPILTIITA

SEQ ID NO: 21021 - protein, 10 aa, Artificial Sequence
  Description of Artificial Sequence: Synthetic peptide
  Seed: WRPILTIITL (TP53 R248W)
WSPILTIITF

SEQ ID NO: 21022 - protein, 10 aa, Artificial Sequence
  Description of Artificial Sequence: Synthetic peptide
  Seed: WRPILTIITL (TP53 R248W)
WSPILTIITI

SEQ ID NO: 21023 - protein, 10 aa, Artificial Sequence
  Description of Artificial Sequence: Synthetic peptide
  Seed: WRPILTIITL (TP53 R248W)
WSPILTIITL

SEQ ID NO: 21024 - protein, 10 aa, Artificial Sequence
  Description of Artificial Sequence: Synthetic peptide
  Seed: WRPILTIITL (TP53 R248W)
WSPILTIITM

SEQ ID NO: 21025 - protein, 10 aa, Artificial Sequence
  Description of Artificial Sequence: Synthetic peptide
  Seed: WRPILTIITL (TP53 R248W)
WSPILTIITV

SEQ ID NO: 21026 - protein, 10 aa, Artificial Sequence
  Description of Artificial Sequence: Synthetic peptide
  Seed: WRPILTIITL (TP53 R248W)
WSPILTIITY

SEQ ID NO: 21027 - protein, 10 aa, Artificial Sequence
  Description of Artificial Sequence: Synthetic peptide
  Seed: WRPILTIITL (TP53 R248W)
WTPILTIITA

SEQ ID NO: 21028 - protein, 10 aa, Artificial Sequence
  Description of Artificial Sequence: Synthetic peptide
  Seed: WRPILTIITL (TP53 R248W)
WTPILTIITF

SEQ ID NO: 21029 - protein, 10 aa, Artificial Sequence
  Description of Artificial Sequence: Synthetic peptide
  Seed: WRPILTIITL (TP53 R248W)
WTPILTIITI

SEQ ID NO: 21030 - protein, 10 aa, Artificial Sequence
  Description of Artificial Sequence: Synthetic peptide
  Seed: WRPILTIITL (TP53 R248W)
WTPILTIITL

SEQ ID NO: 21031 - protein, 10 aa, Artificial Sequence
  Description of Artificial Sequence: Synthetic peptide
  Seed: WRPILTIITL (TP53 R248W)
WTPILTIITM

SEQ ID NO: 21032 - protein, 10 aa, Artificial Sequence
  Description of Artificial Sequence: Synthetic peptide
  Seed: WRPILTIITL (TP53 R248W)
WTPILTIITV

SEQ ID NO: 21033 - protein, 10 aa, Artificial Sequence
  Description of Artificial Sequence: Synthetic peptide
  Seed: WRPILTIITL (TP53 R248W)
WTPILTIITY

SEQ ID NO: 21034 - protein, 10 aa, Artificial Sequence
  Description of Artificial Sequence: Synthetic peptide
  Seed: WRPILTIITL (TP53 R248W)
WVPILTIITA

SEQ ID NO: 21035 - protein, 10 aa, Artificial Sequence
  Description of Artificial Sequence: Synthetic peptide
  Seed: WRPILTIITL (TP53 R248W)
WVPILTIITF

SEQ ID NO: 21036 - protein, 10 aa, Artificial Sequence
  Description of Artificial Sequence: Synthetic peptide
  Seed: WRPILTIITL (TP53 R248W)
WVPILTIITI

SEQ ID NO: 21037 - protein, 10 aa, Artificial Sequence
  Description of Artificial Sequence: Synthetic peptide
  Seed: WRPILTIITL (TP53 R248W)
WVPILTIITL

SEQ ID NO: 21038 - protein, 10 aa, Artificial Sequence
  Description of Artificial Sequence: Synthetic peptide
  Seed: WRPILTIITL (TP53 R248W)
WVPILTIITM

SEQ ID NO: 21039 - protein, 10 aa, Artificial Sequence
  Description of Artificial Sequence: Synthetic peptide
  Seed: WRPILTIITL (TP53 R248W)
WVPILTIITV

SEQ ID NO: 21040 - protein, 10 aa, Artificial Sequence
  Description of Artificial Sequence: Synthetic peptide
  Seed: WRPILTIITL (TP53 R248W)
WVPILTIITY

SEQ ID NO: 21041 - protein, 10 aa, Artificial Sequence
  Description of Artificial Sequence: Synthetic peptide
  Seed: WRPILTIITL (TP53 R248W)
WWPILTIITA

SEQ ID NO: 21042 - protein, 10 aa, Artificial Sequence
  Description of Artificial Sequence: Synthetic peptide
  Seed: WRPILTIITL (TP53 R248W)
WWPILTIITF

SEQ ID NO: 21043 - protein, 10 aa, Artificial Sequence
  Description of Artificial Sequence: Synthetic peptide
  Seed: WRPILTIITL (TP53 R248W)
WWPILTIITI

SEQ ID NO: 21044 - protein, 10 aa, Artificial Sequence
  Description of Artificial Sequence: Synthetic peptide
  Seed: WRPILTIITL (TP53 R248W)
WWPILTIITL

SEQ ID NO: 21045 - protein, 10 aa, Artificial Sequence
  Description of Artificial Sequence: Synthetic peptide
  Seed: WRPILTIITL (TP53 R248W)
WWPILTIITM

SEQ ID NO: 21046 - protein, 10 aa, Artificial Sequence
  Description of Artificial Sequence: Synthetic peptide
  Seed: WRPILTIITL (TP53 R248W)
WWPILTIITV

SEQ ID NO: 21047 - protein, 10 aa, Artificial Sequence
  Description of Artificial Sequence: Synthetic peptide
  Seed: WRPILTIITL (TP53 R248W)
WWPILTIITY

SEQ ID NO: 21048 - protein, 10 aa, Artificial Sequence
  Description of Artificial Sequence: Synthetic peptide
  Seed: WRPILTIITL (TP53 R248W)
WYPILTIITA

SEQ ID NO: 21049 - protein, 10 aa, Artificial Sequence
  Description of Artificial Sequence: Synthetic peptide
  Seed: WRPILTIITL (TP53 R248W)
WYPILTIITF

SEQ ID NO: 21050 - protein, 10 aa, Artificial Sequence
  Description of Artificial Sequence: Synthetic peptide
  Seed: WRPILTIITL (TP53 R248W)
WYPILTIITI

SEQ ID NO: 21051 - protein, 10 aa, Artificial Sequence
  Description of Artificial Sequence: Synthetic peptide
  Seed: WRPILTIITL (TP53 R248W)
WYPILTIITL

SEQ ID NO: 21052 - protein, 10 aa, Artificial Sequence
  Description of Artificial Sequence: Synthetic peptide
  Seed: WRPILTIITL (TP53 R248W)
WYPILTIITM

SEQ ID NO: 21053 - protein, 10 aa, Artificial Sequence
  Description of Artificial Sequence: Synthetic peptide
  Seed: WRPILTIITL (TP53 R248W)
WYPILTIITV

SEQ ID NO: 21054 - protein, 10 aa, Artificial Sequence
  Description of Artificial Sequence: Synthetic peptide
  Seed: WRPILTIITL (TP53 R248W)
WYPILTIITY

SEQ ID NO: 21055 - protein, 9 aa, Artificial Sequence
  Description of Artificial Sequence: Synthetic peptide
  Seed: MNWRPILTI (TP53 R248W)
MAWRPILTC

SEQ ID NO: 21056 - protein, 9 aa, Artificial Sequence
  Description of Artificial Sequence: Synthetic peptide
  Seed: MNWRPILTI (TP53 R248W)
MAWRPILTK

SEQ ID NO: 21057 - protein, 9 aa, Artificial Sequence
  Description of Artificial Sequence: Synthetic peptide
  Seed: MNWRPILTI (TP53 R248W)
MAWRPILTR

SEQ ID NO: 21058 - protein, 9 aa, Artificial Sequence
  Description of Artificial Sequence: Synthetic peptide
  Seed: MNWRPILTI (TP53 R248W)
MAWRPILTT

SEQ ID NO: 21059 - protein, 9 aa, Artificial Sequence
  Description of Artificial Sequence: Synthetic peptide
  Seed: MNWRPILTI (TP53 R248W)
MCWRPILTV

SEQ ID NO: 21060 - protein, 9 aa, Artificial Sequence
  Description of Artificial Sequence: Synthetic peptide
  Seed: MNWRPILTI (TP53 R248W)
MDWRPILTI

SEQ ID NO: 21061 - protein, 9 aa, Artificial Sequence
  Description of Artificial Sequence: Synthetic peptide
  Seed: MNWRPILTI (TP53 R248W)
MDWRPILTK

SEQ ID NO: 21062 - protein, 9 aa, Artificial Sequence
  Description of Artificial Sequence: Synthetic peptide
  Seed: MNWRPILTI (TP53 R248W)
MDWRPILTL

SEQ ID NO: 21063 - protein, 9 aa, Artificial Sequence
  Description of Artificial Sequence: Synthetic peptide
  Seed: MNWRPILTI (TP53 R248W)
MDWRPILTM

SEQ ID NO: 21064 - protein, 9 aa, Artificial Sequence
  Description of Artificial Sequence: Synthetic peptide
  Seed: MNWRPILTI (TP53 R248W)
MDWRPILTR

SEQ ID NO: 21065 - protein, 9 aa, Artificial Sequence
  Description of Artificial Sequence: Synthetic peptide
  Seed: MNWRPILTI (TP53 R248W)
MDWRPILTV

SEQ ID NO: 21066 - protein, 9 aa, Artificial Sequence
  Description of Artificial Sequence: Synthetic peptide
  Seed: MNWRPILTI (TP53 R248W)
MDWRPILTW

SEQ ID NO: 21067 - protein, 9 aa, Artificial Sequence
  Description of Artificial Sequence: Synthetic peptide
  Seed: MNWRPILTI (TP53 R248W)
MEWRPILTA

SEQ ID NO: 21068 - protein, 9 aa, Artificial Sequence
  Description of Artificial Sequence: Synthetic peptide
  Seed: MNWRPILTI (TP53 R248W)
MEWRPILTC

SEQ ID NO: 21069 - protein, 9 aa, Artificial Sequence
  Description of Artificial Sequence: Synthetic peptide
  Seed: MNWRPILTI (TP53 R248W)
MEWRPILTK

SEQ ID NO: 21070 - protein, 9 aa, Artificial Sequence
  Description of Artificial Sequence: Synthetic peptide
  Seed: MNWRPILTI (TP53 R248W)
MEWRPILTR

SEQ ID NO: 21071 - protein, 9 aa, Artificial Sequence
  Description of Artificial Sequence: Synthetic peptide
  Seed: MNWRPILTI (TP53 R248W)
MEWRPILTT

SEQ ID NO: 21072 - protein, 9 aa, Artificial Sequence
  Description of Artificial Sequence: Synthetic peptide
  Seed: MNWRPILTI (TP53 R248W)
MFWRPILTV

SEQ ID NO: 21073 - protein, 9 aa, Artificial Sequence
  Description of Artificial Sequence: Synthetic peptide
  Seed: MNWRPILTI (TP53 R248W)
MGWRPILTA

SEQ ID NO: 21074 - protein, 9 aa, Artificial Sequence
  Description of Artificial Sequence: Synthetic peptide
  Seed: MNWRPILTI (TP53 R248W)
MGWRPILTC

SEQ ID NO: 21075 - protein, 9 aa, Artificial Sequence
  Description of Artificial Sequence: Synthetic peptide
  Seed: MNWRPILTI (TP53 R248W)
MGWRPILTH

SEQ ID NO: 21076 - protein, 9 aa, Artificial Sequence
  Description of Artificial Sequence: Synthetic peptide
  Seed: MNWRPILTI (TP53 R248W)
MGWRPILTK

SEQ ID NO: 21077 - protein, 9 aa, Artificial Sequence
  Description of Artificial Sequence: Synthetic peptide
  Seed: MNWRPILTI (TP53 R248W)
MGWRPILTR

SEQ ID NO: 21078 - protein, 9 aa, Artificial Sequence
  Description of Artificial Sequence: Synthetic peptide
  Seed: MNWRPILTI (TP53 R248W)
MHWRPILTK

SEQ ID NO: 21079 - protein, 9 aa, Artificial Sequence
  Description of Artificial Sequence: Synthetic peptide
  Seed: MNWRPILTI (TP53 R248W)
MHWRPILTR

SEQ ID NO: 21080 - protein, 9 aa, Artificial Sequence
  Description of Artificial Sequence: Synthetic peptide
  Seed: MNWRPILTI (TP53 R248W)
MIWRPILTA

SEQ ID NO: 21081 - protein, 9 aa, Artificial Sequence
  Description of Artificial Sequence: Synthetic peptide
  Seed: MNWRPILTI (TP53 R248W)
MIWRPILTC

SEQ ID NO: 21082 - protein, 9 aa, Artificial Sequence
  Description of Artificial Sequence: Synthetic peptide
  Seed: MNWRPILTI (TP53 R248W)
MIWRPILTK

SEQ ID NO: 21083 - protein, 9 aa, Artificial Sequence
  Description of Artificial Sequence: Synthetic peptide
  Seed: MNWRPILTI (TP53 R248W)
MIWRPILTT

SEQ ID NO: 21084 - protein, 9 aa, Artificial Sequence
  Description of Artificial Sequence: Synthetic peptide
  Seed: MNWRPILTI (TP53 R248W)
MKWRPILTK

SEQ ID NO: 21085 - protein, 9 aa, Artificial Sequence
  Description of Artificial Sequence: Synthetic peptide
  Seed: MNWRPILTI (TP53 R248W)
MKWRPILTR

SEQ ID NO: 21086 - protein, 9 aa, Artificial Sequence
  Description of Artificial Sequence: Synthetic peptide
  Seed: MNWRPILTI (TP53 R248W)
MLWRPILTC

SEQ ID NO: 21087 - protein, 9 aa, Artificial Sequence
  Description of Artificial Sequence: Synthetic peptide
  Seed: MNWRPILTI (TP53 R248W)
MLWRPILTG

SEQ ID NO: 21088 - protein, 9 aa, Artificial Sequence
  Description of Artificial Sequence: Synthetic peptide
  Seed: MNWRPILTI (TP53 R248W)
MLWRPILTK

SEQ ID NO: 21089 - protein, 9 aa, Artificial Sequence
  Description of Artificial Sequence: Synthetic peptide
  Seed: MNWRPILTI (TP53 R248W)
MLWRPILTP

SEQ ID NO: 21090 - protein, 9 aa, Artificial Sequence
  Description of Artificial Sequence: Synthetic peptide
  Seed: MNWRPILTI (TP53 R248W)
MLWRPILTS

SEQ ID NO: 21091 - protein, 9 aa, Artificial Sequence
  Description of Artificial Sequence: Synthetic peptide
  Seed: MNWRPILTI (TP53 R248W)
MLWRPILTT

SEQ ID NO: 21092 - protein, 9 aa, Artificial Sequence
  Description of Artificial Sequence: Synthetic peptide
  Seed: MNWRPILTI (TP53 R248W)
MMWRPILTK

SEQ ID NO: 21093 - protein, 9 aa, Artificial Sequence
  Description of Artificial Sequence: Synthetic peptide
  Seed: MNWRPILTI (TP53 R248W)
MNWRPILTK

SEQ ID NO: 21094 - protein, 9 aa, Artificial Sequence
  Description of Artificial Sequence: Synthetic peptide
  Seed: MNWRPILTI (TP53 R248W)
MNWRPILTR

SEQ ID NO: 21095 - protein, 9 aa, Artificial Sequence
  Description of Artificial Sequence: Synthetic peptide
  Seed: MNWRPILTI (TP53 R248W)
MPWRPILTA

SEQ ID NO: 21096 - protein, 9 aa, Artificial Sequence
  Description of Artificial Sequence: Synthetic peptide
  Seed: MNWRPILTI (TP53 R248W)
MPWRPILTC

SEQ ID NO: 21097 - protein, 9 aa, Artificial Sequence
  Description of Artificial Sequence: Synthetic peptide
  Seed: MNWRPILTI (TP53 R248W)
MPWRPILTI

SEQ ID NO: 21098 - protein, 9 aa, Artificial Sequence
  Description of Artificial Sequence: Synthetic peptide
  Seed: MNWRPILTI (TP53 R248W)
MPWRPILTL

SEQ ID NO: 21099 - protein, 9 aa, Artificial Sequence
  Description of Artificial Sequence: Synthetic peptide
  Seed: MNWRPILTI (TP53 R248W)
MPWRPILTV

SEQ ID NO: 21100 - protein, 9 aa, Artificial Sequence
  Description of Artificial Sequence: Synthetic peptide
  Seed: MNWRPILTI (TP53 R248W)
MQWRPILTK

SEQ ID NO: 21101 - protein, 9 aa, Artificial Sequence
  Description of Artificial Sequence: Synthetic peptide
  Seed: MNWRPILTI (TP53 R248W)
MQWRPILTR

SEQ ID NO: 21102 - protein, 10 aa, Artificial Sequence
  Description of Artificial Sequence: Synthetic peptide
  Seed: MGGMNWRPIL (TP53 R248W)
MRGMNWRPIF

SEQ ID NO: 21103 - protein, 10 aa, Artificial Sequence
  Description of Artificial Sequence: Synthetic peptide
  Seed: MGGMNWRPIL (TP53 R248W)
MRGMNWRPIK

SEQ ID NO: 21104 - protein, 10 aa, Artificial Sequence
  Description of Artificial Sequence: Synthetic peptide
  Seed: MGGMNWRPIL (TP53 R248W)
MRGMNWRPIL

SEQ ID NO: 21105 - protein, 10 aa, Artificial Sequence
  Description of Artificial Sequence: Synthetic peptide
  Seed: MGGMNWRPIL (TP53 R248W)
MRGMNWRPIM

SEQ ID NO: 21106 - protein, 10 aa, Artificial Sequence
  Description of Artificial Sequence: Synthetic peptide
  Seed: MGGMNWRPIL (TP53 R248W)
MRGMNWRPIR

SEQ ID NO: 21107 - protein, 10 aa, Artificial Sequence
  Description of Artificial Sequence: Synthetic peptide
  Seed: MGGMNWRPIL (TP53 R248W)
MRGMNWRPIY

SEQ ID NO: 21108 - protein, 9 aa, Artificial Sequence
  Description of Artificial Sequence: Synthetic peptide
  Seed: MNWRPILTI (TP53 R248W)
MRWRPILTA

SEQ ID NO: 21109 - protein, 9 aa, Artificial Sequence
  Description of Artificial Sequence: Synthetic peptide
  Seed: MNWRPILTI (TP53 R248W)
MRWRPILTC

SEQ ID NO: 21110 - protein, 9 aa, Artificial Sequence
  Description of Artificial Sequence: Synthetic peptide
  Seed: MNWRPILTI (TP53 R248W)
MRWRPILTE

SEQ ID NO: 21111 - protein, 9 aa, Artificial Sequence
  Description of Artificial Sequence: Synthetic peptide
  Seed: MNWRPILTI (TP53 R248W)
MRWRPILTG

SEQ ID NO: 21112 - protein, 9 aa, Artificial Sequence
  Description of Artificial Sequence: Synthetic peptide
  Seed: MNWRPILTI (TP53 R248W)
MRWRPILTK

SEQ ID NO: 21113 - protein, 9 aa, Artificial Sequence
  Description of Artificial Sequence: Synthetic peptide
  Seed: MNWRPILTI (TP53 R248W)
MRWRPILTN

SEQ ID NO: 21114 - protein, 9 aa, Artificial Sequence
  Description of Artificial Sequence: Synthetic peptide
  Seed: MNWRPILTI (TP53 R248W)
MRWRPILTP

SEQ ID NO: 21115 - protein, 9 aa, Artificial Sequence
  Description of Artificial Sequence: Synthetic peptide
  Seed: MNWRPILTI (TP53 R248W)
MRWRPILTQ

SEQ ID NO: 21116 - protein, 9 aa, Artificial Sequence
  Description of Artificial Sequence: Synthetic peptide
  Seed: MNWRPILTI (TP53 R248W)
MRWRPILTR

SEQ ID NO: 21117 - protein, 9 aa, Artificial Sequence
  Description of Artificial Sequence: Synthetic peptide
  Seed: MNWRPILTI (TP53 R248W)
MRWRPILTS

SEQ ID NO: 21118 - protein, 9 aa, Artificial Sequence
  Description of Artificial Sequence: Synthetic peptide
  Seed: MNWRPILTI (TP53 R248W)
MRWRPILTT

SEQ ID NO: 21119 - protein, 9 aa, Artificial Sequence
  Description of Artificial Sequence: Synthetic peptide
  Seed: MNWRPILTI (TP53 R248W)
MSWRPILTK

SEQ ID NO: 21120 - protein, 9 aa, Artificial Sequence
  Description of Artificial Sequence: Synthetic peptide
  Seed: MNWRPILTI (TP53 R248W)
MSWRPILTR

SEQ ID NO: 21121 - protein, 9 aa, Artificial Sequence
  Description of Artificial Sequence: Synthetic peptide
  Seed: MNWRPILTI (TP53 R248W)
MSWRPILTS

SEQ ID NO: 21122 - protein, 9 aa, Artificial Sequence
  Description of Artificial Sequence: Synthetic peptide
  Seed: MNWRPILTI (TP53 R248W)
MTWRPILTK

SEQ ID NO: 21123 - protein, 9 aa, Artificial Sequence
  Description of Artificial Sequence: Synthetic peptide
  Seed: MNWRPILTI (TP53 R248W)
MTWRPILTT

SEQ ID NO: 21124 - protein, 9 aa, Artificial Sequence
  Description of Artificial Sequence: Synthetic peptide
  Seed: MNWRPILTI (TP53 R248W)
MVWRPILTA

SEQ ID NO: 21125 - protein, 9 aa, Artificial Sequence
  Description of Artificial Sequence: Synthetic peptide
  Seed: MNWRPILTI (TP53 R248W)
MVWRPILTC

SEQ ID NO: 21126 - protein, 9 aa, Artificial Sequence
  Description of Artificial Sequence: Synthetic peptide
  Seed: MNWRPILTI (TP53 R248W)
MVWRPILTT

SEQ ID NO: 21127 - protein, 9 aa, Artificial Sequence
  Description of Artificial Sequence: Synthetic peptide
  Seed: MNWRPILTI (TP53 R248W)
MWWRPILTL

SEQ ID NO: 21128 - protein, 9 aa, Artificial Sequence
  Description of Artificial Sequence: Synthetic peptide
  Seed: MNWRPILTI (TP53 R248W)
MWWRPILTV

SEQ ID NO: 21129 - protein, 11 aa, Artificial Sequence
  Description of Artificial Sequence: Synthetic peptide
  Seed: NSSCMGGMNWR (TP53 R248W)
NASCMGGMNWK

SEQ ID NO: 21130 - protein, 11 aa, Artificial Sequence
  Description of Artificial Sequence: Synthetic peptide
  Seed: NSSCMGGMNWR (TP53 R248W)
NGSCMGGMNWK

SEQ ID NO: 21131 - protein, 11 aa, Artificial Sequence
  Description of Artificial Sequence: Synthetic peptide
  Seed: NSSCMGGMNWR (TP53 R248W)
NGSCMGGMNWR

SEQ ID NO: 21132 - protein, 11 aa, Artificial Sequence
  Description of Artificial Sequence: Synthetic peptide
  Seed: NSSCMGGMNWR (TP53 R248W)
NISCMGGMNWK

SEQ ID NO: 21133 - protein, 11 aa, Artificial Sequence
  Description of Artificial Sequence: Synthetic peptide
  Seed: NSSCMGGMNWR (TP53 R248W)
NLSCMGGMNWK

SEQ ID NO: 21134 - protein, 11 aa, Artificial Sequence
  Description of Artificial Sequence: Synthetic peptide
  Seed: NSSCMGGMNWR (TP53 R248W)
NMSCMGGMNWK

SEQ ID NO: 21135 - protein, 11 aa, Artificial Sequence
  Description of Artificial Sequence: Synthetic peptide
  Seed: NSSCMGGMNWR (TP53 R248W)
NQSCMGGMNWK

SEQ ID NO: 21136 - protein, 11 aa, Artificial Sequence
  Description of Artificial Sequence: Synthetic peptide
  Seed: NSSCMGGMNWR (TP53 R248W)
NQSCMGGMNWR

SEQ ID NO: 21137 - protein, 11 aa, Artificial Sequence
  Description of Artificial Sequence: Synthetic peptide
  Seed: NSSCMGGMNWR (TP53 R248W)
NWSCMGGMNWR

SEQ ID NO: 21138 - protein, 11 aa, Artificial Sequence
  Description of Artificial Sequence: Synthetic peptide
  Seed: NSSCMGGMNWR (TP53 R248W)
NYSCMGGMNWK

SEQ ID NO: 21139 - protein, 9 aa, Artificial Sequence
  Description of Artificial Sequence: Synthetic peptide
  Seed: SCMGGMNWR (TP53 R248W)
SAMGGMNWH

SEQ ID NO: 21140 - protein, 9 aa, Artificial Sequence
  Description of Artificial Sequence: Synthetic peptide
  Seed: SCMGGMNWR (TP53 R248W)
SAMGGMNWY

SEQ ID NO: 21141 - protein, 9 aa, Artificial Sequence
  Description of Artificial Sequence: Synthetic peptide
  Seed: SCMGGMNWR (TP53 R248W)
SCMGGMNWK

SEQ ID NO: 21142 - protein, 9 aa, Artificial Sequence
  Description of Artificial Sequence: Synthetic peptide
  Seed: SCMGGMNWR (TP53 R248W)
SDMGGMNWK

SEQ ID NO: 21143 - protein, 9 aa, Artificial Sequence
  Description of Artificial Sequence: Synthetic peptide
  Seed: SCMGGMNWR (TP53 R248W)
SDMGGMNWR

SEQ ID NO: 21144 - protein, 9 aa, Artificial Sequence
  Description of Artificial Sequence: Synthetic peptide
  Seed: SCMGGMNWR (TP53 R248W)
SEMGGMNWK

SEQ ID NO: 21145 - protein, 9 aa, Artificial Sequence
  Description of Artificial Sequence: Synthetic peptide
  Seed: SCMGGMNWR (TP53 R248W)
SEMGGMNWR

SEQ ID NO: 21146 - protein, 9 aa, Artificial Sequence
  Description of Artificial Sequence: Synthetic peptide
  Seed: SCMGGMNWR (TP53 R248W)
SIMGGMNWH

SEQ ID NO: 21147 - protein, 9 aa, Artificial Sequence
  Description of Artificial Sequence: Synthetic peptide
  Seed: SCMGGMNWR (TP53 R248W)
SIMGGMNWL

SEQ ID NO: 21148 - protein, 9 aa, Artificial Sequence
  Description of Artificial Sequence: Synthetic peptide
  Seed: SCMGGMNWR (TP53 R248W)
SIMGGMNWM

SEQ ID NO: 21149 - protein, 9 aa, Artificial Sequence
  Description of Artificial Sequence: Synthetic peptide
  Seed: SCMGGMNWR (TP53 R248W)
SIMGGMNWV

SEQ ID NO: 21150 - protein, 9 aa, Artificial Sequence
  Description of Artificial Sequence: Synthetic peptide
  Seed: SCMGGMNWR (TP53 R248W)
SIMGGMNWY

SEQ ID NO: 21151 - protein, 9 aa, Artificial Sequence
  Description of Artificial Sequence: Synthetic peptide
  Seed: SCMGGMNWR (TP53 R248W)
SLMGGMNWA

SEQ ID NO: 21152 - protein, 9 aa, Artificial Sequence
  Description of Artificial Sequence: Synthetic peptide
  Seed: SCMGGMNWR (TP53 R248W)
SLMGGMNWF

SEQ ID NO: 21153 - protein, 9 aa, Artificial Sequence
  Description of Artificial Sequence: Synthetic peptide
  Seed: SCMGGMNWR (TP53 R248W)
SLMGGMNWH

SEQ ID NO: 21154 - protein, 9 aa, Artificial Sequence
  Description of Artificial Sequence: Synthetic peptide
  Seed: SCMGGMNWR (TP53 R248W)
SLMGGMNWI

SEQ ID NO: 21155 - protein, 9 aa, Artificial Sequence
  Description of Artificial Sequence: Synthetic peptide
  Seed: SCMGGMNWR (TP53 R248W)
SLMGGMNWL

SEQ ID NO: 21156 - protein, 9 aa, Artificial Sequence
  Description of Artificial Sequence: Synthetic peptide
  Seed: SCMGGMNWR (TP53 R248W)
SLMGGMNWM

SEQ ID NO: 21157 - protein, 9 aa, Artificial Sequence
  Description of Artificial Sequence: Synthetic peptide
  Seed: SCMGGMNWR (TP53 R248W)
SLMGGMNWV

SEQ ID NO: 21158 - protein, 9 aa, Artificial Sequence
  Description of Artificial Sequence: Synthetic peptide
  Seed: SCMGGMNWR (TP53 R248W)
SLMGGMNWY

SEQ ID NO: 21159 - protein, 9 aa, Artificial Sequence
  Description of Artificial Sequence: Synthetic peptide
  Seed: SCMGGMNWR (TP53 R248W)
SMMGGMNWA

SEQ ID NO: 21160 - protein, 9 aa, Artificial Sequence
  Description of Artificial Sequence: Synthetic peptide
  Seed: SCMGGMNWR (TP53 R248W)
SMMGGMNWF

SEQ ID NO: 21161 - protein, 9 aa, Artificial Sequence
  Description of Artificial Sequence: Synthetic peptide
  Seed: SCMGGMNWR (TP53 R248W)
SMMGGMNWI

SEQ ID NO: 21162 - protein, 9 aa, Artificial Sequence
  Description of Artificial Sequence: Synthetic peptide
  Seed: SCMGGMNWR (TP53 R248W)
SMMGGMNWL

SEQ ID NO: 21163 - protein, 9 aa, Artificial Sequence
  Description of Artificial Sequence: Synthetic peptide
  Seed: SCMGGMNWR (TP53 R248W)
SMMGGMNWM

SEQ ID NO: 21164 - protein, 9 aa, Artificial Sequence
  Description of Artificial Sequence: Synthetic peptide
  Seed: SCMGGMNWR (TP53 R248W)
SMMGGMNWV

SEQ ID NO: 21165 - protein, 9 aa, Artificial Sequence
  Description of Artificial Sequence: Synthetic peptide
  Seed: SCMGGMNWR (TP53 R248W)
SMMGGMNWY

SEQ ID NO: 21166 - protein, 10 aa, Artificial Sequence
  Description of Artificial Sequence: Synthetic peptide
  Seed: SSCMGGMNWR (TP53 R248W)
SNCMGGMNWK

SEQ ID NO: 21167 - protein, 9 aa, Artificial Sequence
  Description of Artificial Sequence: Synthetic peptide
  Seed: SCMGGMNWR (TP53 R248W)
SPMGGMNWK

SEQ ID NO: 21168 - protein, 9 aa, Artificial Sequence
  Description of Artificial Sequence: Synthetic peptide
  Seed: SCMGGMNWR (TP53 R248W)
SQMGGMNWL

SEQ ID NO: 21169 - protein, 9 aa, Artificial Sequence
  Description of Artificial Sequence: Synthetic peptide
  Seed: SCMGGMNWR (TP53 R248W)
SQMGGMNWY

SEQ ID NO: 21170 - protein, 9 aa, Artificial Sequence
  Description of Artificial Sequence: Synthetic peptide
  Seed: SCMGGMNWR (TP53 R248W)
SRMGGMNWR

SEQ ID NO: 21171 - protein, 9 aa, Artificial Sequence
  Description of Artificial Sequence: Synthetic peptide
  Seed: SCMGGMNWR (TP53 R248W)
SSMGGMNWH

SEQ ID NO: 21172 - protein, 9 aa, Artificial Sequence
  Description of Artificial Sequence: Synthetic peptide
  Seed: SCMGGMNWR (TP53 R248W)
STMGGMNWF

SEQ ID NO: 21173 - protein, 9 aa, Artificial Sequence
  Description of Artificial Sequence: Synthetic peptide
  Seed: SCMGGMNWR (TP53 R248W)
STMGGMNWL

SEQ ID NO: 21174 - protein, 9 aa, Artificial Sequence
  Description of Artificial Sequence: Synthetic peptide
  Seed: SCMGGMNWR (TP53 R248W)
STMGGMNWM

SEQ ID NO: 21175 - protein, 9 aa, Artificial Sequence
  Description of Artificial Sequence: Synthetic peptide
  Seed: SCMGGMNWR (TP53 R248W)
STMGGMNWQ

SEQ ID NO: 21176 - protein, 9 aa, Artificial Sequence
  Description of Artificial Sequence: Synthetic peptide
  Seed: SCMGGMNWR (TP53 R248W)
SVMGGMNWF

SEQ ID NO: 21177 - protein, 9 aa, Artificial Sequence
  Description of Artificial Sequence: Synthetic peptide
  Seed: SCMGGMNWR (TP53 R248W)
SVMGGMNWH

SEQ ID NO: 21178 - protein, 9 aa, Artificial Sequence
  Description of Artificial Sequence: Synthetic peptide
  Seed: SCMGGMNWR (TP53 R248W)
SVMGGMNWL

SEQ ID NO: 21179 - protein, 9 aa, Artificial Sequence
  Description of Artificial Sequence: Synthetic peptide
  Seed: SCMGGMNWR (TP53 R248W)
SVMGGMNWM

SEQ ID NO: 21180 - protein, 9 aa, Artificial Sequence
  Description of Artificial Sequence: Synthetic peptide
  Seed: SCMGGMNWR (TP53 R248W)
SVMGGMNWV

SEQ ID NO: 21181 - protein, 10 aa, Homo sapiens
  Native (TP53 R248W)
CMGGMNWRPI

SEQ ID NO: 21182 - protein, 11 aa, Homo sapiens
  Native (TP53 R248W)
CMGGMNWRPIL

SEQ ID NO: 21183 - protein, 9 aa, Homo sapiens
  Native (TP53 R248W)
GMNWRPILT

SEQ ID NO: 21184 - protein, 10 aa, Homo sapiens
  Native (TP53 R248W)
GMNWRPILTI

SEQ ID NO: 21185 - protein, 11 aa, Homo sapiens
  Native (TP53 R248W)
GMNWRPILTII

SEQ ID NO: 21186 - protein, 9 aa, Homo sapiens
  Native (TP53 R248W)
MNWRPILTI

SEQ ID NO: 21187 - protein, 11 aa, Homo sapiens
  Native (TP53 R248W)
NSSCMGGMNWR

SEQ ID NO: 21188 - protein, 9 aa, Homo sapiens
  Native (TP53 R248W)
SCMGGMNWR

SEQ ID NO: 21189 - protein, 10 aa, Homo sapiens
  Native (TP53 R248W)
SSCMGGMNWR

SEQ ID NO: 21190 - protein, 10 aa, Homo sapiens
  Native (TP53 R248W)
WRPILTIITL

SEQ ID NO: 21191 - protein, 10 aa, Homo sapiens
  Native (TP53 R248W)
MGGMNWRPIL

SEQ ID NO: 21192 - protein, 10 aa, Artificial Sequence
  Description of Artificial Sequence: Synthetic peptide
  Seed: CVCACPGRDR (TP53 R273C)
CFCACPGRDR

SEQ ID NO: 21193 - protein, 10 aa, Artificial Sequence
  Description of Artificial Sequence: Synthetic peptide
  Seed: CVCACPGRDR (TP53 R273C)
CICACPGRDR

SEQ ID NO: 21194 - protein, 10 aa, Artificial Sequence
  Description of Artificial Sequence: Synthetic peptide
  Seed: CVCACPGRDR (TP53 R273C)
CLCACPGRDR

SEQ ID NO: 21195 - protein, 10 aa, Artificial Sequence
  Description of Artificial Sequence: Synthetic peptide
  Seed: CVCACPGRDR (TP53 R273C)
CMCACPGRDR

SEQ ID NO: 21196 - protein, 10 aa, Artificial Sequence
  Description of Artificial Sequence: Synthetic peptide
  Seed: CVCACPGRDR (TP53 R273C)
CQCACPGRDR

SEQ ID NO: 21197 - protein, 10 aa, Artificial Sequence
  Description of Artificial Sequence: Synthetic peptide
  Seed: CVCACPGRDR (TP53 R273C)
CSCACPGRDR

SEQ ID NO: 21198 - protein, 10 aa, Artificial Sequence
  Description of Artificial Sequence: Synthetic peptide
  Seed: CVCACPGRDR (TP53 R273C)
CTCACPGRDR

SEQ ID NO: 21199 - protein, 10 aa, Artificial Sequence
  Description of Artificial Sequence: Synthetic peptide
  Seed: CVCACPGRDR (TP53 R273C)
CYCACPGRDR

SEQ ID NO: 21200 - protein, 10 aa, Artificial Sequence
  Description of Artificial Sequence: Synthetic peptide
  Seed: EVCVCACPGR (TP53 R273C)
EACVCACPGK

SEQ ID NO: 21201 - protein, 10 aa, Artificial Sequence
  Description of Artificial Sequence: Synthetic peptide
  Seed: EVCVCACPGR (TP53 R273C)
EACVCACPGR

SEQ ID NO: 21202 - protein, 10 aa, Artificial Sequence
  Description of Artificial Sequence: Synthetic peptide
  Seed: EVCVCACPGR (TP53 R273C)
EFCVCACPGR

SEQ ID NO: 21203 - protein, 10 aa, Artificial Sequence
  Description of Artificial Sequence: Synthetic peptide
  Seed: EVCVCACPGR (TP53 R273C)
EICVCACPGK

SEQ ID NO: 21204 - protein, 10 aa, Artificial Sequence
  Description of Artificial Sequence: Synthetic peptide
  Seed: EVCVCACPGR (TP53 R273C)
EICVCACPGR

SEQ ID NO: 21205 - protein, 10 aa, Artificial Sequence
  Description of Artificial Sequence: Synthetic peptide
  Seed: EVCVCACPGR (TP53 R273C)
ELCVCACPGR

SEQ ID NO: 21206 - protein, 10 aa, Artificial Sequence
  Description of Artificial Sequence: Synthetic peptide
  Seed: EVCVCACPGR (TP53 R273C)
EMCVCACPGK

SEQ ID NO: 21207 - protein, 10 aa, Artificial Sequence
  Description of Artificial Sequence: Synthetic peptide
  Seed: EVCVCACPGR (TP53 R273C)
EMCVCACPGR

SEQ ID NO: 21208 - protein, 10 aa, Artificial Sequence
  Description of Artificial Sequence: Synthetic peptide
  Seed: EVCVCACPGR (TP53 R273C)
ESCVCACPGK

SEQ ID NO: 21209 - protein, 10 aa, Artificial Sequence
  Description of Artificial Sequence: Synthetic peptide
  Seed: EVCVCACPGR (TP53 R273C)
ESCVCACPGR

SEQ ID NO: 21210 - protein, 10 aa, Artificial Sequence
  Description of Artificial Sequence: Synthetic peptide
  Seed: EVCVCACPGR (TP53 R273C)
ETCVCACPGY

SEQ ID NO: 21211 - protein, 10 aa, Artificial Sequence
  Description of Artificial Sequence: Synthetic peptide
  Seed: EVCVCACPGR (TP53 R273C)
EVCVCACPGK

SEQ ID NO: 21212 - protein, 10 aa, Artificial Sequence
  Description of Artificial Sequence: Synthetic peptide
  Seed: EVCVCACPGR (TP53 R273C)
EWCVCACPGR

SEQ ID NO: 21213 - protein, 9 aa, Artificial Sequence
  Description of Artificial Sequence: Synthetic peptide
  Seed: FEVCVCACP (TP53 R273C)
FEVCVCACA

SEQ ID NO: 21214 - protein, 9 aa, Artificial Sequence
  Description of Artificial Sequence: Synthetic peptide
  Seed: FEVCVCACP (TP53 R273C)
FEVCVCACI

SEQ ID NO: 21215 - protein, 9 aa, Artificial Sequence
  Description of Artificial Sequence: Synthetic peptide
  Seed: FEVCVCACP (TP53 R273C)
FEVCVCACL

SEQ ID NO: 21216 - protein, 9 aa, Artificial Sequence
  Description of Artificial Sequence: Synthetic peptide
  Seed: FEVCVCACP (TP53 R273C)
FEVCVCACV

SEQ ID NO: 21217 - protein, 9 aa, Artificial Sequence
  Description of Artificial Sequence: Synthetic peptide
  Seed: GRNSFEVCV (TP53 R273C)
GRNSFEVCF

SEQ ID NO: 21218 - protein, 9 aa, Artificial Sequence
  Description of Artificial Sequence: Synthetic peptide
  Seed: GRNSFEVCV (TP53 R273C)
GRNSFEVCI

SEQ ID NO: 21219 - protein, 11 aa, Artificial Sequence
  Description of Artificial Sequence: Synthetic peptide
  Seed: LLGRNSFEVCV (TP53 R273C)
LLGRNSFEVCI

SEQ ID NO: 21220 - protein, 11 aa, Artificial Sequence
  Description of Artificial Sequence: Synthetic peptide
  Seed: LLGRNSFEVCV (TP53 R273C)
LLGRNSFEVCL

SEQ ID NO: 21221 - protein, 11 aa, Artificial Sequence
  Description of Artificial Sequence: Synthetic peptide
  Seed: LLGRNSFEVCV (TP53 R273C)
LMGRNSFEVCI

SEQ ID NO: 21222 - protein, 11 aa, Artificial Sequence
  Description of Artificial Sequence: Synthetic peptide
  Seed: LLGRNSFEVCV (TP53 R273C)
LMGRNSFEVCL

SEQ ID NO: 21223 - protein, 11 aa, Artificial Sequence
  Description of Artificial Sequence: Synthetic peptide
  Seed: LLGRNSFEVCV (TP53 R273C)
LMGRNSFEVCV

SEQ ID NO: 21224 - protein, 9 aa, Artificial Sequence
  Description of Artificial Sequence: Synthetic peptide
  Seed: NSFEVCVCA (TP53 R273C)
NAFEVCVCA

SEQ ID NO: 21225 - protein, 9 aa, Artificial Sequence
  Description of Artificial Sequence: Synthetic peptide
  Seed: NSFEVCVCA (TP53 R273C)
NAFEVCVCI

SEQ ID NO: 21226 - protein, 9 aa, Artificial Sequence
  Description of Artificial Sequence: Synthetic peptide
  Seed: NSFEVCVCA (TP53 R273C)
NAFEVCVCL

SEQ ID NO: 21227 - protein, 9 aa, Artificial Sequence
  Description of Artificial Sequence: Synthetic peptide
  Seed: NSFEVCVCA (TP53 R273C)
NAFEVCVCV

SEQ ID NO: 21228 - protein, 9 aa, Artificial Sequence
  Description of Artificial Sequence: Synthetic peptide
  Seed: NSFEVCVCA (TP53 R273C)
NGFEVCVCV

SEQ ID NO: 21229 - protein, 9 aa, Artificial Sequence
  Description of Artificial Sequence: Synthetic peptide
  Seed: NSFEVCVCA (TP53 R273C)
NIFEVCVCA

SEQ ID NO: 21230 - protein, 9 aa, Artificial Sequence
  Description of Artificial Sequence: Synthetic peptide
  Seed: NSFEVCVCA (TP53 R273C)
NIFEVCVCI

SEQ ID NO: 21231 - protein, 9 aa, Artificial Sequence
  Description of Artificial Sequence: Synthetic peptide
  Seed: NSFEVCVCA (TP53 R273C)
NIFEVCVCL

SEQ ID NO: 21232 - protein, 9 aa, Artificial Sequence
  Description of Artificial Sequence: Synthetic peptide
  Seed: NSFEVCVCA (TP53 R273C)
NIFEVCVCV

SEQ ID NO: 21233 - protein, 9 aa, Artificial Sequence
  Description of Artificial Sequence: Synthetic peptide
  Seed: NSFEVCVCA (TP53 R273C)
NLFEVCVCI

SEQ ID NO: 21234 - protein, 9 aa, Artificial Sequence
  Description of Artificial Sequence: Synthetic peptide
  Seed: NSFEVCVCA (TP53 R273C)
NLFEVCVCV

SEQ ID NO: 21235 - protein, 9 aa, Artificial Sequence
  Description of Artificial Sequence: Synthetic peptide
  Seed: NSFEVCVCA (TP53 R273C)
NMFEVCVCA

SEQ ID NO: 21236 - protein, 9 aa, Artificial Sequence
  Description of Artificial Sequence: Synthetic peptide
  Seed: NSFEVCVCA (TP53 R273C)
NMFEVCVCI

SEQ ID NO: 21237 - protein, 9 aa, Artificial Sequence
  Description of Artificial Sequence: Synthetic peptide
  Seed: NSFEVCVCA (TP53 R273C)
NMFEVCVCV

SEQ ID NO: 21238 - protein, 9 aa, Artificial Sequence
  Description of Artificial Sequence: Synthetic peptide
  Seed: NSFEVCVCA (TP53 R273C)
NNFEVCVCV

SEQ ID NO: 21239 - protein, 9 aa, Artificial Sequence
  Description of Artificial Sequence: Synthetic peptide
  Seed: NSFEVCVCA (TP53 R273C)
NQFEVCVCV

SEQ ID NO: 21240 - protein, 9 aa, Artificial Sequence
  Description of Artificial Sequence: Synthetic peptide
  Seed: NSFEVCVCA (TP53 R273C)
NSFEVCVCI

SEQ ID NO: 21241 - protein, 9 aa, Artificial Sequence
  Description of Artificial Sequence: Synthetic peptide
  Seed: NSFEVCVCA (TP53 R273C)
NSFEVCVCL

SEQ ID NO: 21242 - protein, 9 aa, Artificial Sequence
  Description of Artificial Sequence: Synthetic peptide
  Seed: NSFEVCVCA (TP53 R273C)
NSFEVCVCM

SEQ ID NO: 21243 - protein, 9 aa, Artificial Sequence
  Description of Artificial Sequence: Synthetic peptide
  Seed: NSFEVCVCA (TP53 R273C)
NSFEVCVCT

SEQ ID NO: 21244 - protein, 9 aa, Artificial Sequence
  Description of Artificial Sequence: Synthetic peptide
  Seed: NSFEVCVCA (TP53 R273C)
NSFEVCVCV

SEQ ID NO: 21245 - protein, 9 aa, Artificial Sequence
  Description of Artificial Sequence: Synthetic peptide
  Seed: NSFEVCVCA (TP53 R273C)
NTFEVCVCA

SEQ ID NO: 21246 - protein, 9 aa, Artificial Sequence
  Description of Artificial Sequence: Synthetic peptide
  Seed: NSFEVCVCA (TP53 R273C)
NTFEVCVCI

SEQ ID NO: 21247 - protein, 9 aa, Artificial Sequence
  Description of Artificial Sequence: Synthetic peptide
  Seed: NSFEVCVCA (TP53 R273C)
NTFEVCVCL

SEQ ID NO: 21248 - protein, 9 aa, Artificial Sequence
  Description of Artificial Sequence: Synthetic peptide
  Seed: NSFEVCVCA (TP53 R273C)
NTFEVCVCM

SEQ ID NO: 21249 - protein, 9 aa, Artificial Sequence
  Description of Artificial Sequence: Synthetic peptide
  Seed: NSFEVCVCA (TP53 R273C)
NTFEVCVCS

SEQ ID NO: 21250 - protein, 9 aa, Artificial Sequence
  Description of Artificial Sequence: Synthetic peptide
  Seed: NSFEVCVCA (TP53 R273C)
NTFEVCVCT

SEQ ID NO: 21251 - protein, 9 aa, Artificial Sequence
  Description of Artificial Sequence: Synthetic peptide
  Seed: NSFEVCVCA (TP53 R273C)
NVFEVCVCA

SEQ ID NO: 21252 - protein, 9 aa, Artificial Sequence
  Description of Artificial Sequence: Synthetic peptide
  Seed: NSFEVCVCA (TP53 R273C)
NVFEVCVCM

SEQ ID NO: 21253 - protein, 9 aa, Artificial Sequence
  Description of Artificial Sequence: Synthetic peptide
  Seed: NSFEVCVCA (TP53 R273C)
NVFEVCVCT

SEQ ID NO: 21254 - protein, 10 aa, Artificial Sequence
  Description of Artificial Sequence: Synthetic peptide
  Seed: SFEVCVCACP (TP53 R273C)
SAEVCVCACA

SEQ ID NO: 21255 - protein, 10 aa, Artificial Sequence
  Description of Artificial Sequence: Synthetic peptide
  Seed: SFEVCVCACP (TP53 R273C)
SAEVCVCACP

SEQ ID NO: 21256 - protein, 10 aa, Artificial Sequence
  Description of Artificial Sequence: Synthetic peptide
  Seed: SFEVCVCACP (TP53 R273C)
SAEVCVCACV

SEQ ID NO: 21257 - protein, 10 aa, Artificial Sequence
  Description of Artificial Sequence: Synthetic peptide
  Seed: SFEVCVCACP (TP53 R273C)
SCEVCVCACA

SEQ ID NO: 21258 - protein, 10 aa, Artificial Sequence
  Description of Artificial Sequence: Synthetic peptide
  Seed: SFEVCVCACP (TP53 R273C)
SCEVCVCACP

SEQ ID NO: 21259 - protein, 10 aa, Artificial Sequence
  Description of Artificial Sequence: Synthetic peptide
  Seed: SFEVCVCACP (TP53 R273C)
SCEVCVCACV

SEQ ID NO: 21260 - protein, 10 aa, Artificial Sequence
  Description of Artificial Sequence: Synthetic peptide
  Seed: SFEVCVCACP (TP53 R273C)
SDEVCVCACA

SEQ ID NO: 21261 - protein, 10 aa, Artificial Sequence
  Description of Artificial Sequence: Synthetic peptide
  Seed: SFEVCVCACP (TP53 R273C)
SDEVCVCACP

SEQ ID NO: 21262 - protein, 10 aa, Artificial Sequence
  Description of Artificial Sequence: Synthetic peptide
  Seed: SFEVCVCACP (TP53 R273C)
SDEVCVCACV

SEQ ID NO: 21263 - protein, 10 aa, Artificial Sequence
  Description of Artificial Sequence: Synthetic peptide
  Seed: SFEVCVCACP (TP53 R273C)
SEEVCVCACI

SEQ ID NO: 21264 - protein, 10 aa, Artificial Sequence
  Description of Artificial Sequence: Synthetic peptide
  Seed: SFEVCVCACP (TP53 R273C)
SEEVCVCACP

SEQ ID NO: 21265 - protein, 10 aa, Artificial Sequence
  Description of Artificial Sequence: Synthetic peptide
  Seed: SFEVCVCACP (TP53 R273C)
SEEVCVCACT

SEQ ID NO: 21266 - protein, 10 aa, Artificial Sequence
  Description of Artificial Sequence: Synthetic peptide
  Seed: SFEVCVCACP (TP53 R273C)
SEEVCVCACV

SEQ ID NO: 21267 - protein, 10 aa, Artificial Sequence
  Description of Artificial Sequence: Synthetic peptide
  Seed: SFEVCVCACP (TP53 R273C)
SFEVCVCACA

SEQ ID NO: 21268 - protein, 10 aa, Artificial Sequence
  Description of Artificial Sequence: Synthetic peptide
  Seed: SFEVCVCACP (TP53 R273C)
SFEVCVCACV

SEQ ID NO: 21269 - protein, 10 aa, Artificial Sequence
  Description of Artificial Sequence: Synthetic peptide
  Seed: SFEVCVCACP (TP53 R273C)
SGEVCVCACA

SEQ ID NO: 21270 - protein, 10 aa, Artificial Sequence
  Description of Artificial Sequence: Synthetic peptide
  Seed: SFEVCVCACP (TP53 R273C)
SGEVCVCACP

SEQ ID NO: 21271 - protein, 10 aa, Artificial Sequence
  Description of Artificial Sequence: Synthetic peptide
  Seed: SFEVCVCACP (TP53 R273C)
SGEVCVCACV

SEQ ID NO: 21272 - protein, 10 aa, Artificial Sequence
  Description of Artificial Sequence: Synthetic peptide
  Seed: SFEVCVCACP (TP53 R273C)
SHEVCVCACA

SEQ ID NO: 21273 - protein, 10 aa, Artificial Sequence
  Description of Artificial Sequence: Synthetic peptide
  Seed: SFEVCVCACP (TP53 R273C)
SHEVCVCACP

SEQ ID NO: 21274 - protein, 10 aa, Artificial Sequence
  Description of Artificial Sequence: Synthetic peptide
  Seed: SFEVCVCACP (TP53 R273C)
SHEVCVCACV

SEQ ID NO: 21275 - protein, 10 aa, Artificial Sequence
  Description of Artificial Sequence: Synthetic peptide
  Seed: SFEVCVCACP (TP53 R273C)
SIEVCVCACA

SEQ ID NO: 21276 - protein, 10 aa, Artificial Sequence
  Description of Artificial Sequence: Synthetic peptide
  Seed: SFEVCVCACP (TP53 R273C)
SIEVCVCACP

SEQ ID NO: 21277 - protein, 10 aa, Artificial Sequence
  Description of Artificial Sequence: Synthetic peptide
  Seed: SFEVCVCACP (TP53 R273C)
SIEVCVCACV

SEQ ID NO: 21278 - protein, 10 aa, Artificial Sequence
  Description of Artificial Sequence: Synthetic peptide
  Seed: SFEVCVCACP (TP53 R273C)
SKEVCVCACA

SEQ ID NO: 21279 - protein, 10 aa, Artificial Sequence
  Description of Artificial Sequence: Synthetic peptide
  Seed: SFEVCVCACP (TP53 R273C)
SKEVCVCACP

SEQ ID NO: 21280 - protein, 10 aa, Artificial Sequence
  Description of Artificial Sequence: Synthetic peptide
  Seed: SFEVCVCACP (TP53 R273C)
SKEVCVCACV

SEQ ID NO: 21281 - protein, 10 aa, Artificial Sequence
  Description of Artificial Sequence: Synthetic peptide
  Seed: SFEVCVCACP (TP53 R273C)
SLEVCVCACA

SEQ ID NO: 21282 - protein, 10 aa, Artificial Sequence
  Description of Artificial Sequence: Synthetic peptide
  Seed: SFEVCVCACP (TP53 R273C)
SLEVCVCACP

SEQ ID NO: 21283 - protein, 10 aa, Artificial Sequence
  Description of Artificial Sequence: Synthetic peptide
  Seed: SFEVCVCACP (TP53 R273C)
SLEVCVCACV

SEQ ID NO: 21284 - protein, 10 aa, Artificial Sequence
  Description of Artificial Sequence: Synthetic peptide
  Seed: SFEVCVCACP (TP53 R273C)
SMEVCVCACA

SEQ ID NO: 21285 - protein, 10 aa, Artificial Sequence
  Description of Artificial Sequence: Synthetic peptide
  Seed: SFEVCVCACP (TP53 R273C)
SMEVCVCACP

SEQ ID NO: 21286 - protein, 10 aa, Artificial Sequence
  Description of Artificial Sequence: Synthetic peptide
  Seed: SFEVCVCACP (TP53 R273C)
SMEVCVCACV

SEQ ID NO: 21287 - protein, 10 aa, Artificial Sequence
  Description of Artificial Sequence: Synthetic peptide
  Seed: SFEVCVCACP (TP53 R273C)
SNEVCVCACA

SEQ ID NO: 21288 - protein, 10 aa, Artificial Sequence
  Description of Artificial Sequence: Synthetic peptide
  Seed: SFEVCVCACP (TP53 R273C)
SNEVCVCACP

SEQ ID NO: 21289 - protein, 10 aa, Artificial Sequence
  Description of Artificial Sequence: Synthetic peptide
  Seed: SFEVCVCACP (TP53 R273C)
SNEVCVCACV

SEQ ID NO: 21290 - protein, 10 aa, Artificial Sequence
  Description of Artificial Sequence: Synthetic peptide
  Seed: SFEVCVCACP (TP53 R273C)
SPEVCVCACA

SEQ ID NO: 21291 - protein, 10 aa, Artificial Sequence
  Description of Artificial Sequence: Synthetic peptide
  Seed: SFEVCVCACP (TP53 R273C)
SPEVCVCACP

SEQ ID NO: 21292 - protein, 10 aa, Artificial Sequence
  Description of Artificial Sequence: Synthetic peptide
  Seed: SFEVCVCACP (TP53 R273C)
SPEVCVCACV

SEQ ID NO: 21293 - protein, 10 aa, Artificial Sequence
  Description of Artificial Sequence: Synthetic peptide
  Seed: SFEVCVCACP (TP53 R273C)
SQEVCVCACA

SEQ ID NO: 21294 - protein, 10 aa, Artificial Sequence
  Description of Artificial Sequence: Synthetic peptide
  Seed: SFEVCVCACP (TP53 R273C)
SQEVCVCACP

SEQ ID NO: 21295 - protein, 10 aa, Artificial Sequence
  Description of Artificial Sequence: Synthetic peptide
  Seed: SFEVCVCACP (TP53 R273C)
SQEVCVCACV

SEQ ID NO: 21296 - protein, 10 aa, Artificial Sequence
  Description of Artificial Sequence: Synthetic peptide
  Seed: SFEVCVCACP (TP53 R273C)
SREVCVCACA

SEQ ID NO: 21297 - protein, 10 aa, Artificial Sequence
  Description of Artificial Sequence: Synthetic peptide
  Seed: SFEVCVCACP (TP53 R273C)
SREVCVCACP

SEQ ID NO: 21298 - protein, 10 aa, Artificial Sequence
  Description of Artificial Sequence: Synthetic peptide
  Seed: SFEVCVCACP (TP53 R273C)
SREVCVCACV

SEQ ID NO: 21299 - protein, 10 aa, Artificial Sequence
  Description of Artificial Sequence: Synthetic peptide
  Seed: SFEVCVCACP (TP53 R273C)
SSEVCVCACA

SEQ ID NO: 21300 - protein, 10 aa, Artificial Sequence
  Description of Artificial Sequence: Synthetic peptide
  Seed: SFEVCVCACP (TP53 R273C)
SSEVCVCACP

SEQ ID NO: 21301 - protein, 10 aa, Artificial Sequence
  Description of Artificial Sequence: Synthetic peptide
  Seed: SFEVCVCACP (TP53 R273C)
SSEVCVCACV

SEQ ID NO: 21302 - protein, 10 aa, Artificial Sequence
  Description of Artificial Sequence: Synthetic peptide
  Seed: SFEVCVCACP (TP53 R273C)
STEVCVCACA

SEQ ID NO: 21303 - protein, 10 aa, Artificial Sequence
  Description of Artificial Sequence: Synthetic peptide
  Seed: SFEVCVCACP (TP53 R273C)
STEVCVCACP

SEQ ID NO: 21304 - protein, 10 aa, Artificial Sequence
  Description of Artificial Sequence: Synthetic peptide
  Seed: SFEVCVCACP (TP53 R273C)
STEVCVCACV

SEQ ID NO: 21305 - protein, 10 aa, Artificial Sequence
  Description of Artificial Sequence: Synthetic peptide
  Seed: SFEVCVCACP (TP53 R273C)
SVEVCVCACA

SEQ ID NO: 21306 - protein, 10 aa, Artificial Sequence
  Description of Artificial Sequence: Synthetic peptide
  Seed: SFEVCVCACP (TP53 R273C)
SVEVCVCACP

SEQ ID NO: 21307 - protein, 10 aa, Artificial Sequence
  Description of Artificial Sequence: Synthetic peptide
  Seed: SFEVCVCACP (TP53 R273C)
SVEVCVCACV

SEQ ID NO: 21308 - protein, 10 aa, Artificial Sequence
  Description of Artificial Sequence: Synthetic peptide
  Seed: SFEVCVCACP (TP53 R273C)
SWEVCVCACA

SEQ ID NO: 21309 - protein, 10 aa, Artificial Sequence
  Description of Artificial Sequence: Synthetic peptide
  Seed: SFEVCVCACP (TP53 R273C)
SWEVCVCACP

SEQ ID NO: 21310 - protein, 10 aa, Artificial Sequence
  Description of Artificial Sequence: Synthetic peptide
  Seed: SFEVCVCACP (TP53 R273C)
SWEVCVCACV

SEQ ID NO: 21311 - protein, 10 aa, Artificial Sequence
  Description of Artificial Sequence: Synthetic peptide
  Seed: SFEVCVCACP (TP53 R273C)
SYEVCVCACA

SEQ ID NO: 21312 - protein, 10 aa, Artificial Sequence
  Description of Artificial Sequence: Synthetic peptide
  Seed: SFEVCVCACP (TP53 R273C)
SYEVCVCACP

SEQ ID NO: 21313 - protein, 10 aa, Artificial Sequence
  Description of Artificial Sequence: Synthetic peptide
  Seed: SFEVCVCACP (TP53 R273C)
SYEVCVCACV

SEQ ID NO: 21314 - protein, 10 aa, Artificial Sequence
  Description of Artificial Sequence: Synthetic peptide
  Seed: CVCACPGRDR (TP53 R273C)
CACACPGRDK

SEQ ID NO: 21315 - protein, 10 aa, Artificial Sequence
  Description of Artificial Sequence: Synthetic peptide
  Seed: CVCACPGRDR (TP53 R273C)
CACACPGRDR

SEQ ID NO: 21316 - protein, 10 aa, Artificial Sequence
  Description of Artificial Sequence: Synthetic peptide
  Seed: CVCACPGRDR (TP53 R273C)
CICACPGRDK

SEQ ID NO: 21317 - protein, 10 aa, Artificial Sequence
  Description of Artificial Sequence: Synthetic peptide
  Seed: CVCACPGRDR (TP53 R273C)
CLCACPGRDK

SEQ ID NO: 21318 - protein, 10 aa, Artificial Sequence
  Description of Artificial Sequence: Synthetic peptide
  Seed: CVCACPGRDR (TP53 R273C)
CMCACPGRDK

SEQ ID NO: 21319 - protein, 10 aa, Artificial Sequence
  Description of Artificial Sequence: Synthetic peptide
  Seed: CVCACPGRDR (TP53 R273C)
CSCACPGRDK

SEQ ID NO: 21320 - protein, 10 aa, Artificial Sequence
  Description of Artificial Sequence: Synthetic peptide
  Seed: CVCACPGRDR (TP53 R273C)
CTCACPGRDK

SEQ ID NO: 21321 - protein, 11 aa, Artificial Sequence
  Description of Artificial Sequence: Synthetic peptide
  Seed: CVCACPGRDRR (TP53 R273C)
CTCACPGRDRR

SEQ ID NO: 21322 - protein, 10 aa, Artificial Sequence
  Description of Artificial Sequence: Synthetic peptide
  Seed: CVCACPGRDR (TP53 R273C)
CVCACPGRDK

SEQ ID NO: 21323 - protein, 10 aa, Artificial Sequence
  Description of Artificial Sequence: Synthetic peptide
  Seed: CVCACPGRDR (TP53 R273C)
CWCACPGRDR

SEQ ID NO: 21324 - protein, 11 aa, Artificial Sequence
  Description of Artificial Sequence: Synthetic peptide
  Seed: CVCACPGRDRR (TP53 R273C)
CYCACPGRDRR

SEQ ID NO: 21325 - protein, 10 aa, Artificial Sequence
  Description of Artificial Sequence: Synthetic peptide
  Seed: EVCVCACPGR (TP53 R273C)
ECCVCACPGK

SEQ ID NO: 21326 - protein, 10 aa, Artificial Sequence
  Description of Artificial Sequence: Synthetic peptide
  Seed: EVCVCACPGR (TP53 R273C)
ECCVCACPGR

SEQ ID NO: 21327 - protein, 10 aa, Artificial Sequence
  Description of Artificial Sequence: Synthetic peptide
  Seed: EVCVCACPGR (TP53 R273C)
EECVCACPGK

SEQ ID NO: 21328 - protein, 10 aa, Artificial Sequence
  Description of Artificial Sequence: Synthetic peptide
  Seed: EVCVCACPGR (TP53 R273C)
EECVCACPGR

SEQ ID NO: 21329 - protein, 10 aa, Artificial Sequence
  Description of Artificial Sequence: Synthetic peptide
  Seed: EVCVCACPGR (TP53 R273C)
EFCVCACPGK

SEQ ID NO: 21330 - protein, 10 aa, Artificial Sequence
  Description of Artificial Sequence: Synthetic peptide
  Seed: EVCVCACPGR (TP53 R273C)
EGCVCACPGK

SEQ ID NO: 21331 - protein, 10 aa, Artificial Sequence
  Description of Artificial Sequence: Synthetic peptide
  Seed: EVCVCACPGR (TP53 R273C)
EGCVCACPGR

SEQ ID NO: 21332 - protein, 10 aa, Artificial Sequence
  Description of Artificial Sequence: Synthetic peptide
  Seed: EVCVCACPGR (TP53 R273C)
EHCVCACPGR

SEQ ID NO: 21333 - protein, 10 aa, Artificial Sequence
  Description of Artificial Sequence: Synthetic peptide
  Seed: EVCVCACPGR (TP53 R273C)
EICVCACPGY

SEQ ID NO: 21334 - protein, 10 aa, Artificial Sequence
  Description of Artificial Sequence: Synthetic peptide
  Seed: EVCVCACPGR (TP53 R273C)
ELCVCACPGK

SEQ ID NO: 21335 - protein, 10 aa, Artificial Sequence
  Description of Artificial Sequence: Synthetic peptide
  Seed: EVCVCACPGR (TP53 R273C)
ENCVCACPGK

SEQ ID NO: 21336 - protein, 10 aa, Artificial Sequence
  Description of Artificial Sequence: Synthetic peptide
  Seed: EVCVCACPGR (TP53 R273C)
ENCVCACPGR

SEQ ID NO: 21337 - protein, 10 aa, Artificial Sequence
  Description of Artificial Sequence: Synthetic peptide
  Seed: EVCVCACPGR (TP53 R273C)
EQCVCACPGK

SEQ ID NO: 21338 - protein, 10 aa, Artificial Sequence
  Description of Artificial Sequence: Synthetic peptide
  Seed: EVCVCACPGR (TP53 R273C)
EQCVCACPGR

SEQ ID NO: 21339 - protein, 10 aa, Artificial Sequence
  Description of Artificial Sequence: Synthetic peptide
  Seed: EVCVCACPGR (TP53 R273C)
EVCVCACPGY

SEQ ID NO: 21340 - protein, 10 aa, Artificial Sequence
  Description of Artificial Sequence: Synthetic peptide
  Seed: EVCVCACPGR (TP53 R273C)
EWCVCACPGK

SEQ ID NO: 21341 - protein, 10 aa, Artificial Sequence
  Description of Artificial Sequence: Synthetic peptide
  Seed: EVCVCACPGR (TP53 R273C)
EYCVCACPGK

SEQ ID NO: 21342 - protein, 8 aa, Artificial Sequence
  Description of Artificial Sequence: Synthetic peptide
  Seed: FEVCVCAC (TP53 R273C)
FEVCVCAA

SEQ ID NO: 21343 - protein, 9 aa, Artificial Sequence
  Description of Artificial Sequence: Synthetic peptide
  Seed: FEVCVCACP (TP53 R273C)
FEVCVCACC

SEQ ID NO: 21344 - protein, 9 aa, Artificial Sequence
  Description of Artificial Sequence: Synthetic peptide
  Seed: FEVCVCACP (TP53 R273C)
FEVCVCACF

SEQ ID NO: 21345 - protein, 9 aa, Artificial Sequence
  Description of Artificial Sequence: Synthetic peptide
  Seed: FEVCVCACP (TP53 R273C)
FEVCVCACM

SEQ ID NO: 21346 - protein, 9 aa, Artificial Sequence
  Description of Artificial Sequence: Synthetic peptide
  Seed: FEVCVCACP (TP53 R273C)
FEVCVCACS

SEQ ID NO: 21347 - protein, 9 aa, Artificial Sequence
  Description of Artificial Sequence: Synthetic peptide
  Seed: FEVCVCACP (TP53 R273C)
FEVCVCACT

SEQ ID NO: 21348 - protein, 8 aa, Artificial Sequence
  Description of Artificial Sequence: Synthetic peptide
  Seed: FEVCVCAC (TP53 R273C)
FEVCVCAF

SEQ ID NO: 21349 - protein, 8 aa, Artificial Sequence
  Description of Artificial Sequence: Synthetic peptide
  Seed: FEVCVCAC (TP53 R273C)
FEVCVCAI

SEQ ID NO: 21350 - protein, 8 aa, Artificial Sequence
  Description of Artificial Sequence: Synthetic peptide
  Seed: FEVCVCAC (TP53 R273C)
FEVCVCAL

SEQ ID NO: 21351 - protein, 8 aa, Artificial Sequence
  Description of Artificial Sequence: Synthetic peptide
  Seed: FEVCVCAC (TP53 R273C)
FEVCVCAM

SEQ ID NO: 21352 - protein, 8 aa, Artificial Sequence
  Description of Artificial Sequence: Synthetic peptide
  Seed: FEVCVCAC (TP53 R273C)
FEVCVCAP

SEQ ID NO: 21353 - protein, 8 aa, Artificial Sequence
  Description of Artificial Sequence: Synthetic peptide
  Seed: FEVCVCAC (TP53 R273C)
FEVCVCAT

SEQ ID NO: 21354 - protein, 8 aa, Artificial Sequence
  Description of Artificial Sequence: Synthetic peptide
  Seed: FEVCVCAC (TP53 R273C)
FEVCVCAV

SEQ ID NO: 21355 - protein, 9 aa, Artificial Sequence
  Description of Artificial Sequence: Synthetic peptide
  Seed: GRNSFEVCV (TP53 R273C)
GANSFEVCF

SEQ ID NO: 21356 - protein, 9 aa, Artificial Sequence
  Description of Artificial Sequence: Synthetic peptide
  Seed: GRNSFEVCV (TP53 R273C)
GANSFEVCI

SEQ ID NO: 21357 - protein, 9 aa, Artificial Sequence
  Description of Artificial Sequence: Synthetic peptide
  Seed: GRNSFEVCV (TP53 R273C)
GANSFEVCL

SEQ ID NO: 21358 - protein, 9 aa, Artificial Sequence
  Description of Artificial Sequence: Synthetic peptide
  Seed: GRNSFEVCV (TP53 R273C)
GANSFEVCM

SEQ ID NO: 21359 - protein, 9 aa, Artificial Sequence
  Description of Artificial Sequence: Synthetic peptide
  Seed: GRNSFEVCV (TP53 R273C)
GANSFEVCY

SEQ ID NO: 21360 - protein, 9 aa, Artificial Sequence
  Description of Artificial Sequence: Synthetic peptide
  Seed: GRNSFEVCV (TP53 R273C)
GENSFEVCL

SEQ ID NO: 21361 - protein, 9 aa, Artificial Sequence
  Description of Artificial Sequence: Synthetic peptide
  Seed: GRNSFEVCV (TP53 R273C)
GENSFEVCM

SEQ ID NO: 21362 - protein, 9 aa, Artificial Sequence
  Description of Artificial Sequence: Synthetic peptide
  Seed: GRNSFEVCV (TP53 R273C)
GFNSFEVCF

SEQ ID NO: 21363 - protein, 9 aa, Artificial Sequence
  Description of Artificial Sequence: Synthetic peptide
  Seed: GRNSFEVCV (TP53 R273C)
GFNSFEVCL

SEQ ID NO: 21364 - protein, 9 aa, Artificial Sequence
  Description of Artificial Sequence: Synthetic peptide
  Seed: GRNSFEVCV (TP53 R273C)
GFNSFEVCM

SEQ ID NO: 21365 - protein, 9 aa, Artificial Sequence
  Description of Artificial Sequence: Synthetic peptide
  Seed: GRNSFEVCV (TP53 R273C)
GFNSFEVCY

SEQ ID NO: 21366 - protein, 9 aa, Artificial Sequence
  Description of Artificial Sequence: Synthetic peptide
  Seed: GRNSFEVCV (TP53 R273C)
GGNSFEVCL

SEQ ID NO: 21367 - protein, 9 aa, Artificial Sequence
  Description of Artificial Sequence: Synthetic peptide
  Seed: GRNSFEVCV (TP53 R273C)
GHNSFEVCA

SEQ ID NO: 21368 - protein, 9 aa, Artificial Sequence
  Description of Artificial Sequence: Synthetic peptide
  Seed: GRNSFEVCV (TP53 R273C)
GHNSFEVCC

SEQ ID NO: 21369 - protein, 9 aa, Artificial Sequence
  Description of Artificial Sequence: Synthetic peptide
  Seed: GRNSFEVCV (TP53 R273C)
GHNSFEVCF

SEQ ID NO: 21370 - protein, 9 aa, Artificial Sequence
  Description of Artificial Sequence: Synthetic peptide
  Seed: GRNSFEVCV (TP53 R273C)
GHNSFEVCI

SEQ ID NO: 21371 - protein, 9 aa, Artificial Sequence
  Description of Artificial Sequence: Synthetic peptide
  Seed: GRNSFEVCV (TP53 R273C)
GHNSFEVCL

SEQ ID NO: 21372 - protein, 9 aa, Artificial Sequence
  Description of Artificial Sequence: Synthetic peptide
  Seed: GRNSFEVCV (TP53 R273C)
GHNSFEVCM

SEQ ID NO: 21373 - protein, 9 aa, Artificial Sequence
  Description of Artificial Sequence: Synthetic peptide
  Seed: GRNSFEVCV (TP53 R273C)
GHNSFEVCP

SEQ ID NO: 21374 - protein, 9 aa, Artificial Sequence
  Description of Artificial Sequence: Synthetic peptide
  Seed: GRNSFEVCV (TP53 R273C)
GHNSFEVCT

SEQ ID NO: 21375 - protein, 9 aa, Artificial Sequence
  Description of Artificial Sequence: Synthetic peptide
  Seed: GRNSFEVCV (TP53 R273C)
GHNSFEVCV

SEQ ID NO: 21376 - protein, 9 aa, Artificial Sequence
  Description of Artificial Sequence: Synthetic peptide
  Seed: GRNSFEVCV (TP53 R273C)
GHNSFEVCY

SEQ ID NO: 21377 - protein, 9 aa, Artificial Sequence
  Description of Artificial Sequence: Synthetic peptide
  Seed: GRNSFEVCV (TP53 R273C)
GINSFEVCL

SEQ ID NO: 21378 - protein, 9 aa, Artificial Sequence
  Description of Artificial Sequence: Synthetic peptide
  Seed: GRNSFEVCV (TP53 R273C)
GKNSFEVCF

SEQ ID NO: 21379 - protein, 9 aa, Artificial Sequence
  Description of Artificial Sequence: Synthetic peptide
  Seed: GRNSFEVCV (TP53 R273C)
GKNSFEVCL

SEQ ID NO: 21380 - protein, 9 aa, Artificial Sequence
  Description of Artificial Sequence: Synthetic peptide
  Seed: GRNSFEVCV (TP53 R273C)
GKNSFEVCY

SEQ ID NO: 21381 - protein, 9 aa, Artificial Sequence
  Description of Artificial Sequence: Synthetic peptide
  Seed: GRNSFEVCV (TP53 R273C)
GLNSFEVCL

SEQ ID NO: 21382 - protein, 9 aa, Artificial Sequence
  Description of Artificial Sequence: Synthetic peptide
  Seed: GRNSFEVCV (TP53 R273C)
GMNSFEVCL

SEQ ID NO: 21383 - protein, 9 aa, Artificial Sequence
  Description of Artificial Sequence: Synthetic peptide
  Seed: GRNSFEVCV (TP53 R273C)
GNNSFEVCL

SEQ ID NO: 21384 - protein, 9 aa, Artificial Sequence
  Description of Artificial Sequence: Synthetic peptide
  Seed: GRNSFEVCV (TP53 R273C)
GQNSFEVCA

SEQ ID NO: 21385 - protein, 9 aa, Artificial Sequence
  Description of Artificial Sequence: Synthetic peptide
  Seed: GRNSFEVCV (TP53 R273C)
GQNSFEVCF

SEQ ID NO: 21386 - protein, 9 aa, Artificial Sequence
  Description of Artificial Sequence: Synthetic peptide
  Seed: GRNSFEVCV (TP53 R273C)
GQNSFEVCI

SEQ ID NO: 21387 - protein, 9 aa, Artificial Sequence
  Description of Artificial Sequence: Synthetic peptide
  Seed: GRNSFEVCV (TP53 R273C)
GQNSFEVCK

SEQ ID NO: 21388 - protein, 9 aa, Artificial Sequence
  Description of Artificial Sequence: Synthetic peptide
  Seed: GRNSFEVCV (TP53 R273C)
GQNSFEVCL

SEQ ID NO: 21389 - protein, 9 aa, Artificial Sequence
  Description of Artificial Sequence: Synthetic peptide
  Seed: GRNSFEVCV (TP53 R273C)
GQNSFEVCM

SEQ ID NO: 21390 - protein, 9 aa, Artificial Sequence
  Description of Artificial Sequence: Synthetic peptide
  Seed: GRNSFEVCV (TP53 R273C)
GQNSFEVCV

SEQ ID NO: 21391 - protein, 9 aa, Artificial Sequence
  Description of Artificial Sequence: Synthetic peptide
  Seed: GRNSFEVCV (TP53 R273C)
GQNSFEVCY

SEQ ID NO: 21392 - protein, 9 aa, Artificial Sequence
  Description of Artificial Sequence: Synthetic peptide
  Seed: GRNSFEVCV (TP53 R273C)
GRNSFEVCA

SEQ ID NO: 21393 - protein, 9 aa, Artificial Sequence
  Description of Artificial Sequence: Synthetic peptide
  Seed: GRNSFEVCV (TP53 R273C)
GRNSFEVCC

SEQ ID NO: 21394 - protein, 9 aa, Artificial Sequence
  Description of Artificial Sequence: Synthetic peptide
  Seed: GRNSFEVCV (TP53 R273C)
GRNSFEVCH

SEQ ID NO: 21395 - protein, 9 aa, Artificial Sequence
  Description of Artificial Sequence: Synthetic peptide
  Seed: GRNSFEVCV (TP53 R273C)
GRNSFEVCK

SEQ ID NO: 21396 - protein, 9 aa, Artificial Sequence
  Description of Artificial Sequence: Synthetic peptide
  Seed: GRNSFEVCV (TP53 R273C)
GRNSFEVCP

SEQ ID NO: 21397 - protein, 9 aa, Artificial Sequence
  Description of Artificial Sequence: Synthetic peptide
  Seed: GRNSFEVCV (TP53 R273C)
GRNSFEVCQ

SEQ ID NO: 21398 - protein, 9 aa, Artificial Sequence
  Description of Artificial Sequence: Synthetic peptide
  Seed: GRNSFEVCV (TP53 R273C)
GRNSFEVCR

SEQ ID NO: 21399 - protein, 9 aa, Artificial Sequence
  Description of Artificial Sequence: Synthetic peptide
  Seed: GRNSFEVCV (TP53 R273C)
GRNSFEVCT

SEQ ID NO: 21400 - protein, 10 aa, Artificial Sequence
  Description of Artificial Sequence: Synthetic peptide
  Seed: GRNSFEVCVC (TP53 R273C)
GRNSFEVCVA

SEQ ID NO: 21401 - protein, 10 aa, Artificial Sequence
  Description of Artificial Sequence: Synthetic peptide
  Seed: GRNSFEVCVC (TP53 R273C)
GRNSFEVCVF

SEQ ID NO: 21402 - protein, 10 aa, Artificial Sequence
  Description of Artificial Sequence: Synthetic peptide
  Seed: GRNSFEVCVC (TP53 R273C)
GRNSFEVCVI

SEQ ID NO: 21403 - protein, 10 aa, Artificial Sequence
  Description of Artificial Sequence: Synthetic peptide
  Seed: GRNSFEVCVC (TP53 R273C)
GRNSFEVCVL

SEQ ID NO: 21404 - protein, 10 aa, Artificial Sequence
  Description of Artificial Sequence: Synthetic peptide
  Seed: GRNSFEVCVC (TP53 R273C)
GRNSFEVCVM

SEQ ID NO: 21405 - protein, 10 aa, Artificial Sequence
  Description of Artificial Sequence: Synthetic peptide
  Seed: GRNSFEVCVC (TP53 R273C)
GRNSFEVCVP

SEQ ID NO: 21406 - protein, 10 aa, Artificial Sequence
  Description of Artificial Sequence: Synthetic peptide
  Seed: GRNSFEVCVC (TP53 R273C)
GRNSFEVCVR

SEQ ID NO: 21407 - protein, 10 aa, Artificial Sequence
  Description of Artificial Sequence: Synthetic peptide
  Seed: GRNSFEVCVC (TP53 R273C)
GRNSFEVCVV

SEQ ID NO: 21408 - protein, 10 aa, Artificial Sequence
  Description of Artificial Sequence: Synthetic peptide
  Seed: GRNSFEVCVC (TP53 R273C)
GRNSFEVCVW

SEQ ID NO: 21409 - protein, 10 aa, Artificial Sequence
  Description of Artificial Sequence: Synthetic peptide
  Seed: GRNSFEVCVC (TP53 R273C)
GRNSFEVCVY

SEQ ID NO: 21410 - protein, 9 aa, Artificial Sequence
  Description of Artificial Sequence: Synthetic peptide
  Seed: GRNSFEVCV (TP53 R273C)
GRNSFEVCW

SEQ ID NO: 21411 - protein, 9 aa, Artificial Sequence
  Description of Artificial Sequence: Synthetic peptide
  Seed: GRNSFEVCV (TP53 R273C)
GRNSFEVCY

SEQ ID NO: 21412 - protein, 9 aa, Artificial Sequence
  Description of Artificial Sequence: Synthetic peptide
  Seed: GRNSFEVCV (TP53 R273C)
GSNSFEVCL

SEQ ID NO: 21413 - protein, 9 aa, Artificial Sequence
  Description of Artificial Sequence: Synthetic peptide
  Seed: GRNSFEVCV (TP53 R273C)
GSNSFEVCM

SEQ ID NO: 21414 - protein, 9 aa, Artificial Sequence
  Description of Artificial Sequence: Synthetic peptide
  Seed: GRNSFEVCV (TP53 R273C)
GTNSFEVCL

SEQ ID NO: 21415 - protein, 9 aa, Artificial Sequence
  Description of Artificial Sequence: Synthetic peptide
  Seed: GRNSFEVCV (TP53 R273C)
GVNSFEVCL

SEQ ID NO: 21416 - protein, 9 aa, Artificial Sequence
  Description of Artificial Sequence: Synthetic peptide
  Seed: GRNSFEVCV (TP53 R273C)
GWNSFEVCF

SEQ ID NO: 21417 - protein, 9 aa, Artificial Sequence
  Description of Artificial Sequence: Synthetic peptide
  Seed: GRNSFEVCV (TP53 R273C)
GYNSFEVCF

SEQ ID NO: 21418 - protein, 9 aa, Artificial Sequence
  Description of Artificial Sequence: Synthetic peptide
  Seed: GRNSFEVCV (TP53 R273C)
GYNSFEVCL

SEQ ID NO: 21419 - protein, 9 aa, Artificial Sequence
  Description of Artificial Sequence: Synthetic peptide
  Seed: GRNSFEVCV (TP53 R273C)
GYNSFEVCM

SEQ ID NO: 21420 - protein, 9 aa, Artificial Sequence
  Description of Artificial Sequence: Synthetic peptide
  Seed: GRNSFEVCV (TP53 R273C)
GYNSFEVCY

SEQ ID NO: 21421 - protein, 9 aa, Artificial Sequence
  Description of Artificial Sequence: Synthetic peptide
  Seed: NSFEVCVCA (TP53 R273C)
NAFEVCVCM

SEQ ID NO: 21422 - protein, 9 aa, Artificial Sequence
  Description of Artificial Sequence: Synthetic peptide
  Seed: NSFEVCVCA (TP53 R273C)
NIFEVCVCM

SEQ ID NO: 21423 - protein, 9 aa, Artificial Sequence
  Description of Artificial Sequence: Synthetic peptide
  Seed: NSFEVCVCA (TP53 R273C)
NLFEVCVCL

SEQ ID NO: 21424 - protein, 9 aa, Artificial Sequence
  Description of Artificial Sequence: Synthetic peptide
  Seed: NSFEVCVCA (TP53 R273C)
NMFEVCVCL

SEQ ID NO: 21425 - protein, 9 aa, Artificial Sequence
  Description of Artificial Sequence: Synthetic peptide
  Seed: SFEVCVCAC (TP53 R273C)
SAEVCVCAL

SEQ ID NO: 21426 - protein, 9 aa, Artificial Sequence
  Description of Artificial Sequence: Synthetic peptide
  Seed: SFEVCVCAC (TP53 R273C)
SAEVCVCAM

SEQ ID NO: 21427 - protein, 9 aa, Artificial Sequence
  Description of Artificial Sequence: Synthetic peptide
  Seed: SFEVCVCAC (TP53 R273C)
SFEVCVCAF

SEQ ID NO: 21428 - protein, 9 aa, Artificial Sequence
  Description of Artificial Sequence: Synthetic peptide
  Seed: SFEVCVCAC (TP53 R273C)
SFEVCVCAI

SEQ ID NO: 21429 - protein, 9 aa, Artificial Sequence
  Description of Artificial Sequence: Synthetic peptide
  Seed: SFEVCVCAC (TP53 R273C)
SFEVCVCAM

SEQ ID NO: 21430 - protein, 9 aa, Artificial Sequence
  Description of Artificial Sequence: Synthetic peptide
  Seed: SFEVCVCAC (TP53 R273C)
SFEVCVCAV

SEQ ID NO: 21431 - protein, 9 aa, Artificial Sequence
  Description of Artificial Sequence: Synthetic peptide
  Seed: SFEVCVCAC (TP53 R273C)
SFEVCVCAY

SEQ ID NO: 21432 - protein, 9 aa, Artificial Sequence
  Description of Artificial Sequence: Synthetic peptide
  Seed: SFEVCVCAC (TP53 R273C)
SGEVCVCAL

SEQ ID NO: 21433 - protein, 9 aa, Artificial Sequence
  Description of Artificial Sequence: Synthetic peptide
  Seed: SFEVCVCAC (TP53 R273C)
SIEVCVCAL

SEQ ID NO: 21434 - protein, 9 aa, Artificial Sequence
  Description of Artificial Sequence: Synthetic peptide
  Seed: SFEVCVCAC (TP53 R273C)
SLEVCVCAL

SEQ ID NO: 21435 - protein, 9 aa, Artificial Sequence
  Description of Artificial Sequence: Synthetic peptide
  Seed: SFEVCVCAC (TP53 R273C)
SLEVCVCAM

SEQ ID NO: 21436 - protein, 9 aa, Artificial Sequence
  Description of Artificial Sequence: Synthetic peptide
  Seed: SFEVCVCAC (TP53 R273C)
SMEVCVCAL

SEQ ID NO: 21437 - protein, 9 aa, Artificial Sequence
  Description of Artificial Sequence: Synthetic peptide
  Seed: SFEVCVCAC (TP53 R273C)
SMEVCVCAM

SEQ ID NO: 21438 - protein, 9 aa, Artificial Sequence
  Description of Artificial Sequence: Synthetic peptide
  Seed: SFEVCVCAC (TP53 R273C)
SSEVCVCAL

SEQ ID NO: 21439 - protein, 9 aa, Artificial Sequence
  Description of Artificial Sequence: Synthetic peptide
  Seed: SFEVCVCAC (TP53 R273C)
STEVCVCAL

SEQ ID NO: 21440 - protein, 9 aa, Artificial Sequence
  Description of Artificial Sequence: Synthetic peptide
  Seed: SFEVCVCAC (TP53 R273C)
SVEVCVCAL

SEQ ID NO: 21441 - protein, 9 aa, Artificial Sequence
  Description of Artificial Sequence: Synthetic peptide
  Seed: SFEVCVCAC (TP53 R273C)
SWEVCVCAF

SEQ ID NO: 21442 - protein, 9 aa, Artificial Sequence
  Description of Artificial Sequence: Synthetic peptide
  Seed: SFEVCVCAC (TP53 R273C)
SWEVCVCAI

SEQ ID NO: 21443 - protein, 9 aa, Artificial Sequence
  Description of Artificial Sequence: Synthetic peptide
  Seed: SFEVCVCAC (TP53 R273C)
SWEVCVCAL

SEQ ID NO: 21444 - protein, 9 aa, Artificial Sequence
  Description of Artificial Sequence: Synthetic peptide
  Seed: SFEVCVCAC (TP53 R273C)
SWEVCVCAM

SEQ ID NO: 21445 - protein, 9 aa, Artificial Sequence
  Description of Artificial Sequence: Synthetic peptide
  Seed: SFEVCVCAC (TP53 R273C)
SWEVCVCAV

SEQ ID NO: 21446 - protein, 9 aa, Artificial Sequence
  Description of Artificial Sequence: Synthetic peptide
  Seed: SFEVCVCAC (TP53 R273C)
SYEVCVCAC

SEQ ID NO: 21447 - protein, 9 aa, Artificial Sequence
  Description of Artificial Sequence: Synthetic peptide
  Seed: SFEVCVCAC (TP53 R273C)
SYEVCVCAF

SEQ ID NO: 21448 - protein, 9 aa, Artificial Sequence
  Description of Artificial Sequence: Synthetic peptide
  Seed: SFEVCVCAC (TP53 R273C)
SYEVCVCAI

SEQ ID NO: 21449 - protein, 9 aa, Artificial Sequence
  Description of Artificial Sequence: Synthetic peptide
  Seed: SFEVCVCAC (TP53 R273C)
SYEVCVCAL

SEQ ID NO: 21450 - protein, 9 aa, Artificial Sequence
  Description of Artificial Sequence: Synthetic peptide
  Seed: SFEVCVCAC (TP53 R273C)
SYEVCVCAM

SEQ ID NO: 21451 - protein, 9 aa, Artificial Sequence
  Description of Artificial Sequence: Synthetic peptide
  Seed: SFEVCVCAC (TP53 R273C)
SYEVCVCAV

SEQ ID NO: 21452 - protein, 10 aa, Homo sapiens
  Native (TP53 R273C)
CVCACPGRDR

SEQ ID NO: 21453 - protein, 9 aa, Homo sapiens
  Native (TP53 R273C)
FEVCVCACP

SEQ ID NO: 21454 - protein, 9 aa, Homo sapiens
  Native (TP53 R273C)
GRNSFEVCV

SEQ ID NO: 21455 - protein, 11 aa, Homo sapiens
  Native (TP53 R273C)
LLGRNSFEVCV

SEQ ID NO: 21456 - protein, 9 aa, Homo sapiens
  Native (TP53 R273C)
NSFEVCVCA

SEQ ID NO: 21457 - protein, 10 aa, Homo sapiens
  Native (TP53 R273C)
SFEVCVCACP

SEQ ID NO: 21458 - protein, 11 aa, Homo sapiens
  Native (TP53 R273C)
CVCACPGRDRR

SEQ ID NO: 21459 - protein, 8 aa, Homo sapiens
  Native (TP53 R273C)
FEVCVCAC

SEQ ID NO: 21460 - protein, 10 aa, Homo sapiens
  Native (TP53 R273C)
GRNSFEVCVC

SEQ ID NO: 21461 - protein, 11 aa, Homo sapiens
  Native (TP53 R273C)
GRNSFEVCVCA

SEQ ID NO: 21462 - protein, 9 aa, Homo sapiens
  Native (TP53 R273C)
SFEVCVCAC

SEQ ID NO: 21463 - protein, 10 aa, Artificial Sequence
  Description of Artificial Sequence: Synthetic peptide
  Seed: EVHVCACPGR (TP53 R273H)
EAHVCACPGK

SEQ ID NO: 21464 - protein, 10 aa, Artificial Sequence
  Description of Artificial Sequence: Synthetic peptide
  Seed: EVHVCACPGR (TP53 R273H)
EAHVCACPGR

SEQ ID NO: 21465 - protein, 10 aa, Artificial Sequence
  Description of Artificial Sequence: Synthetic peptide
  Seed: EVHVCACPGR (TP53 R273H)
EIHVCACPGK

SEQ ID NO: 21466 - protein, 10 aa, Artificial Sequence
  Description of Artificial Sequence: Synthetic peptide
  Seed: EVHVCACPGR (TP53 R273H)
EIHVCACPGR

SEQ ID NO: 21467 - protein, 10 aa, Artificial Sequence
  Description of Artificial Sequence: Synthetic peptide
  Seed: EVHVCACPGR (TP53 R273H)
ELHVCACPGK

SEQ ID NO: 21468 - protein, 10 aa, Artificial Sequence
  Description of Artificial Sequence: Synthetic peptide
  Seed: EVHVCACPGR (TP53 R273H)
ELHVCACPGR

SEQ ID NO: 21469 - protein, 10 aa, Artificial Sequence
  Description of Artificial Sequence: Synthetic peptide
  Seed: EVHVCACPGR (TP53 R273H)
EMHVCACPGK

SEQ ID NO: 21470 - protein, 10 aa, Artificial Sequence
  Description of Artificial Sequence: Synthetic peptide
  Seed: EVHVCACPGR (TP53 R273H)
EMHVCACPGR

SEQ ID NO: 21471 - protein, 10 aa, Artificial Sequence
  Description of Artificial Sequence: Synthetic peptide
  Seed: EVHVCACPGR (TP53 R273H)
ESHVCACPGK

SEQ ID NO: 21472 - protein, 10 aa, Artificial Sequence
  Description of Artificial Sequence: Synthetic peptide
  Seed: EVHVCACPGR (TP53 R273H)
ESHVCACPGR

SEQ ID NO: 21473 - protein, 10 aa, Artificial Sequence
  Description of Artificial Sequence: Synthetic peptide
  Seed: EVHVCACPGR (TP53 R273H)
ETHVCACPGY

SEQ ID NO: 21474 - protein, 10 aa, Artificial Sequence
  Description of Artificial Sequence: Synthetic peptide
  Seed: EVHVCACPGR (TP53 R273H)
EWHVCACPGR

SEQ ID NO: 21475 - protein, 9 aa, Artificial Sequence
  Description of Artificial Sequence: Synthetic peptide
  Seed: FEVHVCACP (TP53 R273H)
FEVHVCACA

SEQ ID NO: 21476 - protein, 9 aa, Artificial Sequence
  Description of Artificial Sequence: Synthetic peptide
  Seed: FEVHVCACP (TP53 R273H)
FEVHVCACI

SEQ ID NO: 21477 - protein, 9 aa, Artificial Sequence
  Description of Artificial Sequence: Synthetic peptide
  Seed: FEVHVCACP (TP53 R273H)
FEVHVCACV

SEQ ID NO: 21478 - protein, 9 aa, Artificial Sequence
  Description of Artificial Sequence: Synthetic peptide
  Seed: GRNSFEVHV (TP53 R273H)
GQNSFEVHL

SEQ ID NO: 21479 - protein, 9 aa, Artificial Sequence
  Description of Artificial Sequence: Synthetic peptide
  Seed: GRNSFEVHV (TP53 R273H)
GRNSFEVHA

SEQ ID NO: 21480 - protein, 9 aa, Artificial Sequence
  Description of Artificial Sequence: Synthetic peptide
  Seed: GRNSFEVHV (TP53 R273H)
GRNSFEVHI

SEQ ID NO: 21481 - protein, 9 aa, Artificial Sequence
  Description of Artificial Sequence: Synthetic peptide
  Seed: GRNSFEVHV (TP53 R273H)
GRNSFEVHK

SEQ ID NO: 21482 - protein, 9 aa, Artificial Sequence
  Description of Artificial Sequence: Synthetic peptide
  Seed: GRNSFEVHV (TP53 R273H)
GRNSFEVHL

SEQ ID NO: 21483 - protein, 9 aa, Artificial Sequence
  Description of Artificial Sequence: Synthetic peptide
  Seed: GRNSFEVHV (TP53 R273H)
GRNSFEVHM

SEQ ID NO: 21484 - protein, 9 aa, Artificial Sequence
  Description of Artificial Sequence: Synthetic peptide
  Seed: GRNSFEVHV (TP53 R273H)
GRNSFEVHR

SEQ ID NO: 21485 - protein, 10 aa, Artificial Sequence
  Description of Artificial Sequence: Synthetic peptide
  Seed: HVCACPGRDR (TP53 R273H)
HACACPGRDR

SEQ ID NO: 21486 - protein, 10 aa, Artificial Sequence
  Description of Artificial Sequence: Synthetic peptide
  Seed: HVCACPGRDR (TP53 R273H)
HFCACPGRDR

SEQ ID NO: 21487 - protein, 10 aa, Artificial Sequence
  Description of Artificial Sequence: Synthetic peptide
  Seed: HVCACPGRDR (TP53 R273H)
HICACPGRDR

SEQ ID NO: 21488 - protein, 10 aa, Artificial Sequence
  Description of Artificial Sequence: Synthetic peptide
  Seed: HVCACPGRDR (TP53 R273H)
HLCACPGRDR

SEQ ID NO: 21489 - protein, 10 aa, Artificial Sequence
  Description of Artificial Sequence: Synthetic peptide
  Seed: HVCACPGRDR (TP53 R273H)
HMCACPGRDR

SEQ ID NO: 21490 - protein, 10 aa, Artificial Sequence
  Description of Artificial Sequence: Synthetic peptide
  Seed: HVCACPGRDR (TP53 R273H)
HQCACPGRDR

SEQ ID NO: 21491 - protein, 10 aa, Artificial Sequence
  Description of Artificial Sequence: Synthetic peptide
  Seed: HVCACPGRDR (TP53 R273H)
HSCACPGRDR

SEQ ID NO: 21492 - protein, 10 aa, Artificial Sequence
  Description of Artificial Sequence: Synthetic peptide
  Seed: HVCACPGRDR (TP53 R273H)
HTCACPGRDR

SEQ ID NO: 21493 - protein, 10 aa, Artificial Sequence
  Description of Artificial Sequence: Synthetic peptide
  Seed: HVCACPGRDR (TP53 R273H)
HYCACPGRDR

SEQ ID NO: 21494 - protein, 11 aa, Artificial Sequence
  Description of Artificial Sequence: Synthetic peptide
  Seed: LLGRNSFEVHV (TP53 R273H)
LLGRNSFEVHI

SEQ ID NO: 21495 - protein, 11 aa, Artificial Sequence
  Description of Artificial Sequence: Synthetic peptide
  Seed: LLGRNSFEVHV (TP53 R273H)
LLGRNSFEVHL

SEQ ID NO: 21496 - protein, 11 aa, Artificial Sequence
  Description of Artificial Sequence: Synthetic peptide
  Seed: LLGRNSFEVHV (TP53 R273H)
LMGRNSFEVHI

SEQ ID NO: 21497 - protein, 11 aa, Artificial Sequence
  Description of Artificial Sequence: Synthetic peptide
  Seed: LLGRNSFEVHV (TP53 R273H)
LMGRNSFEVHL

SEQ ID NO: 21498 - protein, 9 aa, Artificial Sequence
  Description of Artificial Sequence: Synthetic peptide
  Seed: NSFEVHVCA (TP53 R273H)
NAFEVHVCA

SEQ ID NO: 21499 - protein, 9 aa, Artificial Sequence
  Description of Artificial Sequence: Synthetic peptide
  Seed: NSFEVHVCA (TP53 R273H)
NAFEVHVCI

SEQ ID NO: 21500 - protein, 9 aa, Artificial Sequence
  Description of Artificial Sequence: Synthetic peptide
  Seed: NSFEVHVCA (TP53 R273H)
NAFEVHVCL

SEQ ID NO: 21501 - protein, 9 aa, Artificial Sequence
  Description of Artificial Sequence: Synthetic peptide
  Seed: NSFEVHVCA (TP53 R273H)
NAFEVHVCM

SEQ ID NO: 21502 - protein, 9 aa, Artificial Sequence
  Description of Artificial Sequence: Synthetic peptide
  Seed: NSFEVHVCA (TP53 R273H)
NAFEVHVCT

SEQ ID NO: 21503 - protein, 9 aa, Artificial Sequence
  Description of Artificial Sequence: Synthetic peptide
  Seed: NSFEVHVCA (TP53 R273H)
NCFEVHVCV

SEQ ID NO: 21504 - protein, 9 aa, Artificial Sequence
  Description of Artificial Sequence: Synthetic peptide
  Seed: NSFEVHVCA (TP53 R273H)
NFFEVHVCV

SEQ ID NO: 21505 - protein, 9 aa, Artificial Sequence
  Description of Artificial Sequence: Synthetic peptide
  Seed: NSFEVHVCA (TP53 R273H)
NGFEVHVCV

SEQ ID NO: 21506 - protein, 9 aa, Artificial Sequence
  Description of Artificial Sequence: Synthetic peptide
  Seed: NSFEVHVCA (TP53 R273H)
NIFEVHVCA

SEQ ID NO: 21507 - protein, 9 aa, Artificial Sequence
  Description of Artificial Sequence: Synthetic peptide
  Seed: NSFEVHVCA (TP53 R273H)
NIFEVHVCI

SEQ ID NO: 21508 - protein, 9 aa, Artificial Sequence
  Description of Artificial Sequence: Synthetic peptide
  Seed: NSFEVHVCA (TP53 R273H)
NIFEVHVCL

SEQ ID NO: 21509 - protein, 9 aa, Artificial Sequence
  Description of Artificial Sequence: Synthetic peptide
  Seed: NSFEVHVCA (TP53 R273H)
NIFEVHVCM

SEQ ID NO: 21510 - protein, 9 aa, Artificial Sequence
  Description of Artificial Sequence: Synthetic peptide
  Seed: NSFEVHVCA (TP53 R273H)
NIFEVHVCT

SEQ ID NO: 21511 - protein, 9 aa, Artificial Sequence
  Description of Artificial Sequence: Synthetic peptide
  Seed: NSFEVHVCA (TP53 R273H)
NIFEVHVCV

SEQ ID NO: 21512 - protein, 9 aa, Artificial Sequence
  Description of Artificial Sequence: Synthetic peptide
  Seed: NSFEVHVCA (TP53 R273H)
NLFEVHVCA

SEQ ID NO: 21513 - protein, 9 aa, Artificial Sequence
  Description of Artificial Sequence: Synthetic peptide
  Seed: NSFEVHVCA (TP53 R273H)
NLFEVHVCI

SEQ ID NO: 21514 - protein, 9 aa, Artificial Sequence
  Description of Artificial Sequence: Synthetic peptide
  Seed: NSFEVHVCA (TP53 R273H)
NLFEVHVCL

SEQ ID NO: 21515 - protein, 9 aa, Artificial Sequence
  Description of Artificial Sequence: Synthetic peptide
  Seed: NSFEVHVCA (TP53 R273H)
NLFEVHVCM

SEQ ID NO: 21516 - protein, 9 aa, Artificial Sequence
  Description of Artificial Sequence: Synthetic peptide
  Seed: NSFEVHVCA (TP53 R273H)
NLFEVHVCV

SEQ ID NO: 21517 - protein, 9 aa, Artificial Sequence
  Description of Artificial Sequence: Synthetic peptide
  Seed: NSFEVHVCA (TP53 R273H)
NMFEVHVCA

SEQ ID NO: 21518 - protein, 9 aa, Artificial Sequence
  Description of Artificial Sequence: Synthetic peptide
  Seed: NSFEVHVCA (TP53 R273H)
NMFEVHVCI

SEQ ID NO: 21519 - protein, 9 aa, Artificial Sequence
  Description of Artificial Sequence: Synthetic peptide
  Seed: NSFEVHVCA (TP53 R273H)
NMFEVHVCL

SEQ ID NO: 21520 - protein, 9 aa, Artificial Sequence
  Description of Artificial Sequence: Synthetic peptide
  Seed: NSFEVHVCA (TP53 R273H)
NMFEVHVCM

SEQ ID NO: 21521 - protein, 9 aa, Artificial Sequence
  Description of Artificial Sequence: Synthetic peptide
  Seed: NSFEVHVCA (TP53 R273H)
NMFEVHVCV

SEQ ID NO: 21522 - protein, 9 aa, Artificial Sequence
  Description of Artificial Sequence: Synthetic peptide
  Seed: NSFEVHVCA (TP53 R273H)
NNFEVHVCI

SEQ ID NO: 21523 - protein, 9 aa, Artificial Sequence
  Description of Artificial Sequence: Synthetic peptide
  Seed: NSFEVHVCA (TP53 R273H)
NNFEVHVCV

SEQ ID NO: 21524 - protein, 9 aa, Artificial Sequence
  Description of Artificial Sequence: Synthetic peptide
  Seed: NSFEVHVCA (TP53 R273H)
NPFEVHVCC

SEQ ID NO: 21525 - protein, 9 aa, Artificial Sequence
  Description of Artificial Sequence: Synthetic peptide
  Seed: NSFEVHVCA (TP53 R273H)
NPFEVHVCI

SEQ ID NO: 21526 - protein, 9 aa, Artificial Sequence
  Description of Artificial Sequence: Synthetic peptide
  Seed: NSFEVHVCA (TP53 R273H)
NPFEVHVCP

SEQ ID NO: 21527 - protein, 9 aa, Artificial Sequence
  Description of Artificial Sequence: Synthetic peptide
  Seed: NSFEVHVCA (TP53 R273H)
NPFEVHVCS

SEQ ID NO: 21528 - protein, 9 aa, Artificial Sequence
  Description of Artificial Sequence: Synthetic peptide
  Seed: NSFEVHVCA (TP53 R273H)
NPFEVHVCT

SEQ ID NO: 21529 - protein, 9 aa, Artificial Sequence
  Description of Artificial Sequence: Synthetic peptide
  Seed: NSFEVHVCA (TP53 R273H)
NQFEVHVCV

SEQ ID NO: 21530 - protein, 9 aa, Artificial Sequence
  Description of Artificial Sequence: Synthetic peptide
  Seed: NSFEVHVCA (TP53 R273H)
NSFEVHVCI

SEQ ID NO: 21531 - protein, 9 aa, Artificial Sequence
  Description of Artificial Sequence: Synthetic peptide
  Seed: NSFEVHVCA (TP53 R273H)
NSFEVHVCL

SEQ ID NO: 21532 - protein, 9 aa, Artificial Sequence
  Description of Artificial Sequence: Synthetic peptide
  Seed: NSFEVHVCA (TP53 R273H)
NSFEVHVCM

SEQ ID NO: 21533 - protein, 9 aa, Artificial Sequence
  Description of Artificial Sequence: Synthetic peptide
  Seed: NSFEVHVCA (TP53 R273H)
NSFEVHVCT

SEQ ID NO: 21534 - protein, 9 aa, Artificial Sequence
  Description of Artificial Sequence: Synthetic peptide
  Seed: NSFEVHVCA (TP53 R273H)
NSFEVHVCV

SEQ ID NO: 21535 - protein, 9 aa, Artificial Sequence
  Description of Artificial Sequence: Synthetic peptide
  Seed: NSFEVHVCA (TP53 R273H)
NTFEVHVCA

SEQ ID NO: 21536 - protein, 9 aa, Artificial Sequence
  Description of Artificial Sequence: Synthetic peptide
  Seed: NSFEVHVCA (TP53 R273H)
NTFEVHVCC

SEQ ID NO: 21537 - protein, 9 aa, Artificial Sequence
  Description of Artificial Sequence: Synthetic peptide
  Seed: NSFEVHVCA (TP53 R273H)
NTFEVHVCF

SEQ ID NO: 21538 - protein, 9 aa, Artificial Sequence
  Description of Artificial Sequence: Synthetic peptide
  Seed: NSFEVHVCA (TP53 R273H)
NTFEVHVCI

SEQ ID NO: 21539 - protein, 9 aa, Artificial Sequence
  Description of Artificial Sequence: Synthetic peptide
  Seed: NSFEVHVCA (TP53 R273H)
NTFEVHVCL

SEQ ID NO: 21540 - protein, 9 aa, Artificial Sequence
  Description of Artificial Sequence: Synthetic peptide
  Seed: NSFEVHVCA (TP53 R273H)
NTFEVHVCM

SEQ ID NO: 21541 - protein, 9 aa, Artificial Sequence
  Description of Artificial Sequence: Synthetic peptide
  Seed: NSFEVHVCA (TP53 R273H)
NTFEVHVCS

SEQ ID NO: 21542 - protein, 9 aa, Artificial Sequence
  Description of Artificial Sequence: Synthetic peptide
  Seed: NSFEVHVCA (TP53 R273H)
NTFEVHVCT

SEQ ID NO: 21543 - protein, 9 aa, Artificial Sequence
  Description of Artificial Sequence: Synthetic peptide
  Seed: NSFEVHVCA (TP53 R273H)
NVFEVHVCA

SEQ ID NO: 21544 - protein, 9 aa, Artificial Sequence
  Description of Artificial Sequence: Synthetic peptide
  Seed: NSFEVHVCA (TP53 R273H)
NVFEVHVCI

SEQ ID NO: 21545 - protein, 9 aa, Artificial Sequence
  Description of Artificial Sequence: Synthetic peptide
  Seed: NSFEVHVCA (TP53 R273H)
NVFEVHVCL

SEQ ID NO: 21546 - protein, 9 aa, Artificial Sequence
  Description of Artificial Sequence: Synthetic peptide
  Seed: NSFEVHVCA (TP53 R273H)
NVFEVHVCM

SEQ ID NO: 21547 - protein, 9 aa, Artificial Sequence
  Description of Artificial Sequence: Synthetic peptide
  Seed: NSFEVHVCA (TP53 R273H)
NVFEVHVCS

SEQ ID NO: 21548 - protein, 9 aa, Artificial Sequence
  Description of Artificial Sequence: Synthetic peptide
  Seed: NSFEVHVCA (TP53 R273H)
NVFEVHVCT

SEQ ID NO: 21549 - protein, 10 aa, Artificial Sequence
  Description of Artificial Sequence: Synthetic peptide
  Seed: EVHVCACPGR (TP53 R273H)
ECHVCACPGK

SEQ ID NO: 21550 - protein, 10 aa, Artificial Sequence
  Description of Artificial Sequence: Synthetic peptide
  Seed: EVHVCACPGR (TP53 R273H)
ECHVCACPGR

SEQ ID NO: 21551 - protein, 10 aa, Artificial Sequence
  Description of Artificial Sequence: Synthetic peptide
  Seed: EVHVCACPGR (TP53 R273H)
EFHVCACPGK

SEQ ID NO: 21552 - protein, 10 aa, Artificial Sequence
  Description of Artificial Sequence: Synthetic peptide
  Seed: EVHVCACPGR (TP53 R273H)
EGHVCACPGK

SEQ ID NO: 21553 - protein, 10 aa, Artificial Sequence
  Description of Artificial Sequence: Synthetic peptide
  Seed: EVHVCACPGR (TP53 R273H)
EGHVCACPGR

SEQ ID NO: 21554 - protein, 10 aa, Artificial Sequence
  Description of Artificial Sequence: Synthetic peptide
  Seed: EVHVCACPGR (TP53 R273H)
EIHVCACPGY

SEQ ID NO: 21555 - protein, 10 aa, Artificial Sequence
  Description of Artificial Sequence: Synthetic peptide
  Seed: EVHVCACPGR (TP53 R273H)
ENHVCACPGK

SEQ ID NO: 21556 - protein, 10 aa, Artificial Sequence
  Description of Artificial Sequence: Synthetic peptide
  Seed: EVHVCACPGR (TP53 R273H)
ENHVCACPGR

SEQ ID NO: 21557 - protein, 10 aa, Artificial Sequence
  Description of Artificial Sequence: Synthetic peptide
  Seed: EVHVCACPGR (TP53 R273H)
EQHVCACPGK

SEQ ID NO: 21558 - protein, 10 aa, Artificial Sequence
  Description of Artificial Sequence: Synthetic peptide
  Seed: EVHVCACPGR (TP53 R273H)
EQHVCACPGR

SEQ ID NO: 21559 - protein, 10 aa, Artificial Sequence
  Description of Artificial Sequence: Synthetic peptide
  Seed: EVHVCACPGR (TP53 R273H)
EVHVCACPGY

SEQ ID NO: 21560 - protein, 10 aa, Artificial Sequence
  Description of Artificial Sequence: Synthetic peptide
  Seed: EVHVCACPGR (TP53 R273H)
EWHVCACPGK

SEQ ID NO: 21561 - protein, 10 aa, Artificial Sequence
  Description of Artificial Sequence: Synthetic peptide
  Seed: EVHVCACPGR (TP53 R273H)
EYHVCACPGK

SEQ ID NO: 21562 - protein, 9 aa, Artificial Sequence
  Description of Artificial Sequence: Synthetic peptide
  Seed: FEVHVCACP (TP53 R273H)
FDVHVCACA

SEQ ID NO: 21563 - protein, 9 aa, Artificial Sequence
  Description of Artificial Sequence: Synthetic peptide
  Seed: FEVHVCACP (TP53 R273H)
FDVHVCACV

SEQ ID NO: 21564 - protein, 8 aa, Artificial Sequence
  Description of Artificial Sequence: Synthetic peptide
  Seed: FEVHVCAC (TP53 R273H)
FDVHVCAL

SEQ ID NO: 21565 - protein, 8 aa, Artificial Sequence
  Description of Artificial Sequence: Synthetic peptide
  Seed: FEVHVCAC (TP53 R273H)
FEVHVCAA

SEQ ID NO: 21566 - protein, 9 aa, Artificial Sequence
  Description of Artificial Sequence: Synthetic peptide
  Seed: FEVHVCACP (TP53 R273H)
FEVHVCACC

SEQ ID NO: 21567 - protein, 9 aa, Artificial Sequence
  Description of Artificial Sequence: Synthetic peptide
  Seed: FEVHVCACP (TP53 R273H)
FEVHVCACF

SEQ ID NO: 21568 - protein, 9 aa, Artificial Sequence
  Description of Artificial Sequence: Synthetic peptide
  Seed: FEVHVCACP (TP53 R273H)
FEVHVCACG

SEQ ID NO: 21569 - protein, 9 aa, Artificial Sequence
  Description of Artificial Sequence: Synthetic peptide
  Seed: FEVHVCACP (TP53 R273H)
FEVHVCACL

SEQ ID NO: 21570 - protein, 9 aa, Artificial Sequence
  Description of Artificial Sequence: Synthetic peptide
  Seed: FEVHVCACP (TP53 R273H)
FEVHVCACM

SEQ ID NO: 21571 - protein, 9 aa, Artificial Sequence
  Description of Artificial Sequence: Synthetic peptide
  Seed: FEVHVCACP (TP53 R273H)
FEVHVCACS

SEQ ID NO: 21572 - protein, 9 aa, Artificial Sequence
  Description of Artificial Sequence: Synthetic peptide
  Seed: FEVHVCACP (TP53 R273H)
FEVHVCACT

SEQ ID NO: 21573 - protein, 8 aa, Artificial Sequence
  Description of Artificial Sequence: Synthetic peptide
  Seed: FEVHVCAC (TP53 R273H)
FEVHVCAF

SEQ ID NO: 21574 - protein, 8 aa, Artificial Sequence
  Description of Artificial Sequence: Synthetic peptide
  Seed: FEVHVCAC (TP53 R273H)
FEVHVCAI

SEQ ID NO: 21575 - protein, 8 aa, Artificial Sequence
  Description of Artificial Sequence: Synthetic peptide
  Seed: FEVHVCAC (TP53 R273H)
FEVHVCAL

SEQ ID NO: 21576 - protein, 8 aa, Artificial Sequence
  Description of Artificial Sequence: Synthetic peptide
  Seed: FEVHVCAC (TP53 R273H)
FEVHVCAM

SEQ ID NO: 21577 - protein, 8 aa, Artificial Sequence
  Description of Artificial Sequence: Synthetic peptide
  Seed: FEVHVCAC (TP53 R273H)
FEVHVCAP

SEQ ID NO: 21578 - protein, 8 aa, Artificial Sequence
  Description of Artificial Sequence: Synthetic peptide
  Seed: FEVHVCAC (TP53 R273H)
FEVHVCAS

SEQ ID NO: 21579 - protein, 8 aa, Artificial Sequence
  Description of Artificial Sequence: Synthetic peptide
  Seed: FEVHVCAC (TP53 R273H)
FEVHVCAT

SEQ ID NO: 21580 - protein, 8 aa, Artificial Sequence
  Description of Artificial Sequence: Synthetic peptide
  Seed: FEVHVCAC (TP53 R273H)
FEVHVCAV

SEQ ID NO: 21581 - protein, 9 aa, Artificial Sequence
  Description of Artificial Sequence: Synthetic peptide
  Seed: GRNSFEVHV (TP53 R273H)
GANSFEVHF

SEQ ID NO: 21582 - protein, 9 aa, Artificial Sequence
  Description of Artificial Sequence: Synthetic peptide
  Seed: GRNSFEVHV (TP53 R273H)
GANSFEVHI

SEQ ID NO: 21583 - protein, 9 aa, Artificial Sequence
  Description of Artificial Sequence: Synthetic peptide
  Seed: GRNSFEVHV (TP53 R273H)
GANSFEVHL

SEQ ID NO: 21584 - protein, 9 aa, Artificial Sequence
  Description of Artificial Sequence: Synthetic peptide
  Seed: GRNSFEVHV (TP53 R273H)
GANSFEVHM

SEQ ID NO: 21585 - protein, 9 aa, Artificial Sequence
  Description of Artificial Sequence: Synthetic peptide
  Seed: GRNSFEVHV (TP53 R273H)
GANSFEVHV

SEQ ID NO: 21586 - protein, 9 aa, Artificial Sequence
  Description of Artificial Sequence: Synthetic peptide
  Seed: GRNSFEVHV (TP53 R273H)
GANSFEVHY

SEQ ID NO: 21587 - protein, 9 aa, Artificial Sequence
  Description of Artificial Sequence: Synthetic peptide
  Seed: GRNSFEVHV (TP53 R273H)
GDNSFEVHL

SEQ ID NO: 21588 - protein, 9 aa, Artificial Sequence
  Description of Artificial Sequence: Synthetic peptide
  Seed: GRNSFEVHV (TP53 R273H)
GDNSFEVHM

SEQ ID NO: 21589 - protein, 9 aa, Artificial Sequence
  Description of Artificial Sequence: Synthetic peptide
  Seed: GRNSFEVHV (TP53 R273H)
GENSFEVHF

SEQ ID NO: 21590 - protein, 9 aa, Artificial Sequence
  Description of Artificial Sequence: Synthetic peptide
  Seed: GRNSFEVHV (TP53 R273H)
GENSFEVHI

SEQ ID NO: 21591 - protein, 9 aa, Artificial Sequence
  Description of Artificial Sequence: Synthetic peptide
  Seed: GRNSFEVHV (TP53 R273H)
GENSFEVHL

SEQ ID NO: 21592 - protein, 9 aa, Artificial Sequence
  Description of Artificial Sequence: Synthetic peptide
  Seed: GRNSFEVHV (TP53 R273H)
GENSFEVHM

SEQ ID NO: 21593 - protein, 9 aa, Artificial Sequence
  Description of Artificial Sequence: Synthetic peptide
  Seed: GRNSFEVHV (TP53 R273H)
GENSFEVHV

SEQ ID NO: 21594 - protein, 9 aa, Artificial Sequence
  Description of Artificial Sequence: Synthetic peptide
  Seed: GRNSFEVHV (TP53 R273H)
GFNSFEVHF

SEQ ID NO: 21595 - protein, 9 aa, Artificial Sequence
  Description of Artificial Sequence: Synthetic peptide
  Seed: GRNSFEVHV (TP53 R273H)
GFNSFEVHI

SEQ ID NO: 21596 - protein, 9 aa, Artificial Sequence
  Description of Artificial Sequence: Synthetic peptide
  Seed: GRNSFEVHV (TP53 R273H)
GFNSFEVHL

SEQ ID NO: 21597 - protein, 9 aa, Artificial Sequence
  Description of Artificial Sequence: Synthetic peptide
  Seed: GRNSFEVHV (TP53 R273H)
GFNSFEVHM

SEQ ID NO: 21598 - protein, 9 aa, Artificial Sequence
  Description of Artificial Sequence: Synthetic peptide
  Seed: GRNSFEVHV (TP53 R273H)
GFNSFEVHY

SEQ ID NO: 21599 - protein, 9 aa, Artificial Sequence
  Description of Artificial Sequence: Synthetic peptide
  Seed: GRNSFEVHV (TP53 R273H)
GGNSFEVHF

SEQ ID NO: 21600 - protein, 9 aa, Artificial Sequence
  Description of Artificial Sequence: Synthetic peptide
  Seed: GRNSFEVHV (TP53 R273H)
GGNSFEVHL

SEQ ID NO: 21601 - protein, 9 aa, Artificial Sequence
  Description of Artificial Sequence: Synthetic peptide
  Seed: GRNSFEVHV (TP53 R273H)
GGNSFEVHM

SEQ ID NO: 21602 - protein, 9 aa, Artificial Sequence
  Description of Artificial Sequence: Synthetic peptide
  Seed: GRNSFEVHV (TP53 R273H)
GGNSFEVHY

SEQ ID NO: 21603 - protein, 9 aa, Artificial Sequence
  Description of Artificial Sequence: Synthetic peptide
  Seed: GRNSFEVHV (TP53 R273H)
GHNSFEVHA

SEQ ID NO: 21604 - protein, 9 aa, Artificial Sequence
  Description of Artificial Sequence: Synthetic peptide
  Seed: GRNSFEVHV (TP53 R273H)
GHNSFEVHC

SEQ ID NO: 21605 - protein, 9 aa, Artificial Sequence
  Description of Artificial Sequence: Synthetic peptide
  Seed: GRNSFEVHV (TP53 R273H)
GHNSFEVHF

SEQ ID NO: 21606 - protein, 9 aa, Artificial Sequence
  Description of Artificial Sequence: Synthetic peptide
  Seed: GRNSFEVHV (TP53 R273H)
GHNSFEVHI

SEQ ID NO: 21607 - protein, 9 aa, Artificial Sequence
  Description of Artificial Sequence: Synthetic peptide
  Seed: GRNSFEVHV (TP53 R273H)
GHNSFEVHL

SEQ ID NO: 21608 - protein, 9 aa, Artificial Sequence
  Description of Artificial Sequence: Synthetic peptide
  Seed: GRNSFEVHV (TP53 R273H)
GHNSFEVHM

SEQ ID NO: 21609 - protein, 9 aa, Artificial Sequence
  Description of Artificial Sequence: Synthetic peptide
  Seed: GRNSFEVHV (TP53 R273H)
GHNSFEVHP

SEQ ID NO: 21610 - protein, 9 aa, Artificial Sequence
  Description of Artificial Sequence: Synthetic peptide
  Seed: GRNSFEVHV (TP53 R273H)
GHNSFEVHT

SEQ ID NO: 21611 - protein, 9 aa, Artificial Sequence
  Description of Artificial Sequence: Synthetic peptide
  Seed: GRNSFEVHV (TP53 R273H)
GHNSFEVHV

SEQ ID NO: 21612 - protein, 9 aa, Artificial Sequence
  Description of Artificial Sequence: Synthetic peptide
  Seed: GRNSFEVHV (TP53 R273H)
GHNSFEVHY

SEQ ID NO: 21613 - protein, 9 aa, Artificial Sequence
  Description of Artificial Sequence: Synthetic peptide
  Seed: GRNSFEVHV (TP53 R273H)
GINSFEVHL

SEQ ID NO: 21614 - protein, 9 aa, Artificial Sequence
  Description of Artificial Sequence: Synthetic peptide
  Seed: GRNSFEVHV (TP53 R273H)
GINSFEVHM

SEQ ID NO: 21615 - protein, 9 aa, Artificial Sequence
  Description of Artificial Sequence: Synthetic peptide
  Seed: GRNSFEVHV (TP53 R273H)
GKNSFEVHF

SEQ ID NO: 21616 - protein, 9 aa, Artificial Sequence
  Description of Artificial Sequence: Synthetic peptide
  Seed: GRNSFEVHV (TP53 R273H)
GKNSFEVHL

SEQ ID NO: 21617 - protein, 9 aa, Artificial Sequence
  Description of Artificial Sequence: Synthetic peptide
  Seed: GRNSFEVHV (TP53 R273H)
GKNSFEVHM

SEQ ID NO: 21618 - protein, 9 aa, Artificial Sequence
  Description of Artificial Sequence: Synthetic peptide
  Seed: GRNSFEVHV (TP53 R273H)
GKNSFEVHY

SEQ ID NO: 21619 - protein, 9 aa, Artificial Sequence
  Description of Artificial Sequence: Synthetic peptide
  Seed: GRNSFEVHV (TP53 R273H)
GLNSFEVHF

SEQ ID NO: 21620 - protein, 9 aa, Artificial Sequence
  Description of Artificial Sequence: Synthetic peptide
  Seed: GRNSFEVHV (TP53 R273H)
GLNSFEVHL

SEQ ID NO: 21621 - protein, 9 aa, Artificial Sequence
  Description of Artificial Sequence: Synthetic peptide
  Seed: GRNSFEVHV (TP53 R273H)
GLNSFEVHM

SEQ ID NO: 21622 - protein, 9 aa, Artificial Sequence
  Description of Artificial Sequence: Synthetic peptide
  Seed: GRNSFEVHV (TP53 R273H)
GMNSFEVHF

SEQ ID NO: 21623 - protein, 9 aa, Artificial Sequence
  Description of Artificial Sequence: Synthetic peptide
  Seed: GRNSFEVHV (TP53 R273H)
GMNSFEVHL

SEQ ID NO: 21624 - protein, 9 aa, Artificial Sequence
  Description of Artificial Sequence: Synthetic peptide
  Seed: GRNSFEVHV (TP53 R273H)
GMNSFEVHM

SEQ ID NO: 21625 - protein, 9 aa, Artificial Sequence
  Description of Artificial Sequence: Synthetic peptide
  Seed: GRNSFEVHV (TP53 R273H)
GMNSFEVHY

SEQ ID NO: 21626 - protein, 9 aa, Artificial Sequence
  Description of Artificial Sequence: Synthetic peptide
  Seed: GRNSFEVHV (TP53 R273H)
GNNSFEVHF

SEQ ID NO: 21627 - protein, 9 aa, Artificial Sequence
  Description of Artificial Sequence: Synthetic peptide
  Seed: GRNSFEVHV (TP53 R273H)
GNNSFEVHI

SEQ ID NO: 21628 - protein, 9 aa, Artificial Sequence
  Description of Artificial Sequence: Synthetic peptide
  Seed: GRNSFEVHV (TP53 R273H)
GNNSFEVHL

SEQ ID NO: 21629 - protein, 9 aa, Artificial Sequence
  Description of Artificial Sequence: Synthetic peptide
  Seed: GRNSFEVHV (TP53 R273H)
GNNSFEVHM

SEQ ID NO: 21630 - protein, 9 aa, Artificial Sequence
  Description of Artificial Sequence: Synthetic peptide
  Seed: GRNSFEVHV (TP53 R273H)
GNNSFEVHY

SEQ ID NO: 21631 - protein, 9 aa, Artificial Sequence
  Description of Artificial Sequence: Synthetic peptide
  Seed: GRNSFEVHV (TP53 R273H)
GPNSFEVHL

SEQ ID NO: 21632 - protein, 9 aa, Artificial Sequence
  Description of Artificial Sequence: Synthetic peptide
  Seed: GRNSFEVHV (TP53 R273H)
GQNSFEVHA

SEQ ID NO: 21633 - protein, 9 aa, Artificial Sequence
  Description of Artificial Sequence: Synthetic peptide
  Seed: GRNSFEVHV (TP53 R273H)
GQNSFEVHF

SEQ ID NO: 21634 - protein, 9 aa, Artificial Sequence
  Description of Artificial Sequence: Synthetic peptide
  Seed: GRNSFEVHV (TP53 R273H)
GQNSFEVHI

SEQ ID NO: 21635 - protein, 9 aa, Artificial Sequence
  Description of Artificial Sequence: Synthetic peptide
  Seed: GRNSFEVHV (TP53 R273H)
GQNSFEVHK

SEQ ID NO: 21636 - protein, 9 aa, Artificial Sequence
  Description of Artificial Sequence: Synthetic peptide
  Seed: GRNSFEVHV (TP53 R273H)
GQNSFEVHM

SEQ ID NO: 21637 - protein, 9 aa, Artificial Sequence
  Description of Artificial Sequence: Synthetic peptide
  Seed: GRNSFEVHV (TP53 R273H)
GQNSFEVHR

SEQ ID NO: 21638 - protein, 9 aa, Artificial Sequence
  Description of Artificial Sequence: Synthetic peptide
  Seed: GRNSFEVHV (TP53 R273H)
GQNSFEVHV

SEQ ID NO: 21639 - protein, 10 aa, Artificial Sequence
  Description of Artificial Sequence: Synthetic peptide
  Seed: GRNSFEVHVC (TP53 R273H)
GQNSFEVHVL

SEQ ID NO: 21640 - protein, 10 aa, Artificial Sequence
  Description of Artificial Sequence: Synthetic peptide
  Seed: GRNSFEVHVC (TP53 R273H)
GQNSFEVHVY

SEQ ID NO: 21641 - protein, 9 aa, Artificial Sequence
  Description of Artificial Sequence: Synthetic peptide
  Seed: GRNSFEVHV (TP53 R273H)
GQNSFEVHY

SEQ ID NO: 21642 - protein, 9 aa, Artificial Sequence
  Description of Artificial Sequence: Synthetic peptide
  Seed: GRNSFEVHV (TP53 R273H)
GRNSFEVHC

SEQ ID NO: 21643 - protein, 9 aa, Artificial Sequence
  Description of Artificial Sequence: Synthetic peptide
  Seed: GRNSFEVHV (TP53 R273H)
GRNSFEVHH

SEQ ID NO: 21644 - protein, 9 aa, Artificial Sequence
  Description of Artificial Sequence: Synthetic peptide
  Seed: GRNSFEVHV (TP53 R273H)
GRNSFEVHP

SEQ ID NO: 21645 - protein, 9 aa, Artificial Sequence
  Description of Artificial Sequence: Synthetic peptide
  Seed: GRNSFEVHV (TP53 R273H)
GRNSFEVHQ

SEQ ID NO: 21646 - protein, 9 aa, Artificial Sequence
  Description of Artificial Sequence: Synthetic peptide
  Seed: GRNSFEVHV (TP53 R273H)
GRNSFEVHT

SEQ ID NO: 21647 - protein, 10 aa, Artificial Sequence
  Description of Artificial Sequence: Synthetic peptide
  Seed: GRNSFEVHVC (TP53 R273H)
GRNSFEVHVA

SEQ ID NO: 21648 - protein, 10 aa, Artificial Sequence
  Description of Artificial Sequence: Synthetic peptide
  Seed: GRNSFEVHVC (TP53 R273H)
GRNSFEVHVF

SEQ ID NO: 21649 - protein, 10 aa, Artificial Sequence
  Description of Artificial Sequence: Synthetic peptide
  Seed: GRNSFEVHVC (TP53 R273H)
GRNSFEVHVH

SEQ ID NO: 21650 - protein, 10 aa, Artificial Sequence
  Description of Artificial Sequence: Synthetic peptide
  Seed: GRNSFEVHVC (TP53 R273H)
GRNSFEVHVI

SEQ ID NO: 21651 - protein, 10 aa, Artificial Sequence
  Description of Artificial Sequence: Synthetic peptide
  Seed: GRNSFEVHVC (TP53 R273H)
GRNSFEVHVK

SEQ ID NO: 21652 - protein, 10 aa, Artificial Sequence
  Description of Artificial Sequence: Synthetic peptide
  Seed: GRNSFEVHVC (TP53 R273H)
GRNSFEVHVL

SEQ ID NO: 21653 - protein, 10 aa, Artificial Sequence
  Description of Artificial Sequence: Synthetic peptide
  Seed: GRNSFEVHVC (TP53 R273H)
GRNSFEVHVM

SEQ ID NO: 21654 - protein, 10 aa, Artificial Sequence
  Description of Artificial Sequence: Synthetic peptide
  Seed: GRNSFEVHVC (TP53 R273H)
GRNSFEVHVP

SEQ ID NO: 21655 - protein, 10 aa, Artificial Sequence
  Description of Artificial Sequence: Synthetic peptide
  Seed: GRNSFEVHVC (TP53 R273H)
GRNSFEVHVQ

SEQ ID NO: 21656 - protein, 10 aa, Artificial Sequence
  Description of Artificial Sequence: Synthetic peptide
  Seed: GRNSFEVHVC (TP53 R273H)
GRNSFEVHVR

SEQ ID NO: 21657 - protein, 10 aa, Artificial Sequence
  Description of Artificial Sequence: Synthetic peptide
  Seed: GRNSFEVHVC (TP53 R273H)
GRNSFEVHVT

SEQ ID NO: 21658 - protein, 10 aa, Artificial Sequence
  Description of Artificial Sequence: Synthetic peptide
  Seed: GRNSFEVHVC (TP53 R273H)
GRNSFEVHVV

SEQ ID NO: 21659 - protein, 10 aa, Artificial Sequence
  Description of Artificial Sequence: Synthetic peptide
  Seed: GRNSFEVHVC (TP53 R273H)
GRNSFEVHVW

SEQ ID NO: 21660 - protein, 10 aa, Artificial Sequence
  Description of Artificial Sequence: Synthetic peptide
  Seed: GRNSFEVHVC (TP53 R273H)
GRNSFEVHVY

SEQ ID NO: 21661 - protein, 9 aa, Artificial Sequence
  Description of Artificial Sequence: Synthetic peptide
  Seed: GRNSFEVHV (TP53 R273H)
GRNSFEVHW

SEQ ID NO: 21662 - protein, 9 aa, Artificial Sequence
  Description of Artificial Sequence: Synthetic peptide
  Seed: GRNSFEVHV (TP53 R273H)
GSNSFEVHF

SEQ ID NO: 21663 - protein, 9 aa, Artificial Sequence
  Description of Artificial Sequence: Synthetic peptide
  Seed: GRNSFEVHV (TP53 R273H)
GSNSFEVHI

SEQ ID NO: 21664 - protein, 9 aa, Artificial Sequence
  Description of Artificial Sequence: Synthetic peptide
  Seed: GRNSFEVHV (TP53 R273H)
GSNSFEVHL

SEQ ID NO: 21665 - protein, 9 aa, Artificial Sequence
  Description of Artificial Sequence: Synthetic peptide
  Seed: GRNSFEVHV (TP53 R273H)
GSNSFEVHM

SEQ ID NO: 21666 - protein, 9 aa, Artificial Sequence
  Description of Artificial Sequence: Synthetic peptide
  Seed: GRNSFEVHV (TP53 R273H)
GTNSFEVHL

SEQ ID NO: 21667 - protein, 9 aa, Artificial Sequence
  Description of Artificial Sequence: Synthetic peptide
  Seed: GRNSFEVHV (TP53 R273H)
GTNSFEVHM

SEQ ID NO: 21668 - protein, 9 aa, Artificial Sequence
  Description of Artificial Sequence: Synthetic peptide
  Seed: GRNSFEVHV (TP53 R273H)
GVNSFEVHL

SEQ ID NO: 21669 - protein, 9 aa, Artificial Sequence
  Description of Artificial Sequence: Synthetic peptide
  Seed: GRNSFEVHV (TP53 R273H)
GVNSFEVHM

SEQ ID NO: 21670 - protein, 9 aa, Artificial Sequence
  Description of Artificial Sequence: Synthetic peptide
  Seed: GRNSFEVHV (TP53 R273H)
GWNSFEVHF

SEQ ID NO: 21671 - protein, 9 aa, Artificial Sequence
  Description of Artificial Sequence: Synthetic peptide
  Seed: GRNSFEVHV (TP53 R273H)
GWNSFEVHL

SEQ ID NO: 21672 - protein, 9 aa, Artificial Sequence
  Description of Artificial Sequence: Synthetic peptide
  Seed: GRNSFEVHV (TP53 R273H)
GWNSFEVHM

SEQ ID NO: 21673 - protein, 9 aa, Artificial Sequence
  Description of Artificial Sequence: Synthetic peptide
  Seed: GRNSFEVHV (TP53 R273H)
GWNSFEVHY

SEQ ID NO: 21674 - protein, 9 aa, Artificial Sequence
  Description of Artificial Sequence: Synthetic peptide
  Seed: GRNSFEVHV (TP53 R273H)
GYNSFEVHF

SEQ ID NO: 21675 - protein, 9 aa, Artificial Sequence
  Description of Artificial Sequence: Synthetic peptide
  Seed: GRNSFEVHV (TP53 R273H)
GYNSFEVHI

SEQ ID NO: 21676 - protein, 9 aa, Artificial Sequence
  Description of Artificial Sequence: Synthetic peptide
  Seed: GRNSFEVHV (TP53 R273H)
GYNSFEVHL

SEQ ID NO: 21677 - protein, 9 aa, Artificial Sequence
  Description of Artificial Sequence: Synthetic peptide
  Seed: GRNSFEVHV (TP53 R273H)
GYNSFEVHM

SEQ ID NO: 21678 - protein, 9 aa, Artificial Sequence
  Description of Artificial Sequence: Synthetic peptide
  Seed: GRNSFEVHV (TP53 R273H)
GYNSFEVHV

SEQ ID NO: 21679 - protein, 9 aa, Artificial Sequence
  Description of Artificial Sequence: Synthetic peptide
  Seed: GRNSFEVHV (TP53 R273H)
GYNSFEVHY

SEQ ID NO: 21680 - protein, 10 aa, Artificial Sequence
  Description of Artificial Sequence: Synthetic peptide
  Seed: HVCACPGRDR (TP53 R273H)
HACACPGRDF

SEQ ID NO: 21681 - protein, 10 aa, Artificial Sequence
  Description of Artificial Sequence: Synthetic peptide
  Seed: HVCACPGRDR (TP53 R273H)
HACACPGRDK

SEQ ID NO: 21682 - protein, 10 aa, Artificial Sequence
  Description of Artificial Sequence: Synthetic peptide
  Seed: HVCACPGRDR (TP53 R273H)
HACACPGRDL

SEQ ID NO: 21683 - protein, 10 aa, Artificial Sequence
  Description of Artificial Sequence: Synthetic peptide
  Seed: HVCACPGRDR (TP53 R273H)
HACACPGRDM

SEQ ID NO: 21684 - protein, 11 aa, Artificial Sequence
  Description of Artificial Sequence: Synthetic peptide
  Seed: HVCACPGRDRR (TP53 R273H)
HACACPGRDRK

SEQ ID NO: 21685 - protein, 11 aa, Artificial Sequence
  Description of Artificial Sequence: Synthetic peptide
  Seed: HVCACPGRDRR (TP53 R273H)
HACACPGRDRR

SEQ ID NO: 21686 - protein, 11 aa, Artificial Sequence
  Description of Artificial Sequence: Synthetic peptide
  Seed: HVCACPGRDRR (TP53 R273H)
HFCACPGRDRR

SEQ ID NO: 21687 - protein, 10 aa, Artificial Sequence
  Description of Artificial Sequence: Synthetic peptide
  Seed: HVCACPGRDR (TP53 R273H)
HGCACPGRDK

SEQ ID NO: 21688 - protein, 10 aa, Artificial Sequence
  Description of Artificial Sequence: Synthetic peptide
  Seed: HVCACPGRDR (TP53 R273H)
HGCACPGRDR

SEQ ID NO: 21689 - protein, 10 aa, Artificial Sequence
  Description of Artificial Sequence: Synthetic peptide
  Seed: HVCACPGRDR (TP53 R273H)
HICACPGRDK

SEQ ID NO: 21690 - protein, 11 aa, Artificial Sequence
  Description of Artificial Sequence: Synthetic peptide
  Seed: HVCACPGRDRR (TP53 R273H)
HICACPGRDRK

SEQ ID NO: 21691 - protein, 11 aa, Artificial Sequence
  Description of Artificial Sequence: Synthetic peptide
  Seed: HVCACPGRDRR (TP53 R273H)
HICACPGRDRR

SEQ ID NO: 21692 - protein, 10 aa, Artificial Sequence
  Description of Artificial Sequence: Synthetic peptide
  Seed: HVCACPGRDR (TP53 R273H)
HLCACPGRDK

SEQ ID NO: 21693 - protein, 11 aa, Artificial Sequence
  Description of Artificial Sequence: Synthetic peptide
  Seed: HVCACPGRDRR (TP53 R273H)
HLCACPGRDRK

SEQ ID NO: 21694 - protein, 11 aa, Artificial Sequence
  Description of Artificial Sequence: Synthetic peptide
  Seed: HVCACPGRDRR (TP53 R273H)
HLCACPGRDRR

SEQ ID NO: 21695 - protein, 10 aa, Artificial Sequence
  Description of Artificial Sequence: Synthetic peptide
  Seed: HVCACPGRDR (TP53 R273H)
HMCACPGRDK

SEQ ID NO: 21696 - protein, 11 aa, Artificial Sequence
  Description of Artificial Sequence: Synthetic peptide
  Seed: HVCACPGRDRR (TP53 R273H)
HMCACPGRDRK

SEQ ID NO: 21697 - protein, 11 aa, Artificial Sequence
  Description of Artificial Sequence: Synthetic peptide
  Seed: HVCACPGRDRR (TP53 R273H)
HMCACPGRDRR

SEQ ID NO: 21698 - protein, 10 aa, Artificial Sequence
  Description of Artificial Sequence: Synthetic peptide
  Seed: HVCACPGRDR (TP53 R273H)
HQCACPGRDK

SEQ ID NO: 21699 - protein, 10 aa, Artificial Sequence
  Description of Artificial Sequence: Synthetic peptide
  Seed: HVCACPGRDR (TP53 R273H)
HSCACPGRDK

SEQ ID NO: 21700 - protein, 11 aa, Artificial Sequence
  Description of Artificial Sequence: Synthetic peptide
  Seed: HVCACPGRDRR (TP53 R273H)
HSCACPGRDRK

SEQ ID NO: 21701 - protein, 11 aa, Artificial Sequence
  Description of Artificial Sequence: Synthetic peptide
  Seed: HVCACPGRDRR (TP53 R273H)
HSCACPGRDRR

SEQ ID NO: 21702 - protein, 10 aa, Artificial Sequence
  Description of Artificial Sequence: Synthetic peptide
  Seed: HVCACPGRDR (TP53 R273H)
HTCACPGRDK

SEQ ID NO: 21703 - protein, 11 aa, Artificial Sequence
  Description of Artificial Sequence: Synthetic peptide
  Seed: HVCACPGRDRR (TP53 R273H)
HTCACPGRDRK

SEQ ID NO: 21704 - protein, 11 aa, Artificial Sequence
  Description of Artificial Sequence: Synthetic peptide
  Seed: HVCACPGRDRR (TP53 R273H)
HTCACPGRDRR

SEQ ID NO: 21705 - protein, 10 aa, Artificial Sequence
  Description of Artificial Sequence: Synthetic peptide
  Seed: HVCACPGRDR (TP53 R273H)
HTCACPGRDY

SEQ ID NO: 21706 - protein, 10 aa, Artificial Sequence
  Description of Artificial Sequence: Synthetic peptide
  Seed: HVCACPGRDR (TP53 R273H)
HVCACPGRDK

SEQ ID NO: 21707 - protein, 11 aa, Artificial Sequence
  Description of Artificial Sequence: Synthetic peptide
  Seed: HVCACPGRDRR (TP53 R273H)
HVCACPGRDRK

SEQ ID NO: 21708 - protein, 10 aa, Artificial Sequence
  Description of Artificial Sequence: Synthetic peptide
  Seed: HVCACPGRDR (TP53 R273H)
HVCACPGRDY

SEQ ID NO: 21709 - protein, 10 aa, Artificial Sequence
  Description of Artificial Sequence: Synthetic peptide
  Seed: HVCACPGRDR (TP53 R273H)
HWCACPGRDR

SEQ ID NO: 21710 - protein, 11 aa, Artificial Sequence
  Description of Artificial Sequence: Synthetic peptide
  Seed: HVCACPGRDRR (TP53 R273H)
HWCACPGRDRR

SEQ ID NO: 21711 - protein, 10 aa, Artificial Sequence
  Description of Artificial Sequence: Synthetic peptide
  Seed: HVCACPGRDR (TP53 R273H)
HYCACPGRDK

SEQ ID NO: 21712 - protein, 11 aa, Artificial Sequence
  Description of Artificial Sequence: Synthetic peptide
  Seed: HVCACPGRDRR (TP53 R273H)
HYCACPGRDRK

SEQ ID NO: 21713 - protein, 11 aa, Artificial Sequence
  Description of Artificial Sequence: Synthetic peptide
  Seed: HVCACPGRDRR (TP53 R273H)
HYCACPGRDRR

SEQ ID NO: 21714 - protein, 9 aa, Artificial Sequence
  Description of Artificial Sequence: Synthetic peptide
  Seed: NSFEVHVCA (TP53 R273H)
NAFEVHVCC

SEQ ID NO: 21715 - protein, 9 aa, Artificial Sequence
  Description of Artificial Sequence: Synthetic peptide
  Seed: NSFEVHVCA (TP53 R273H)
NGFEVHVCA

SEQ ID NO: 21716 - protein, 9 aa, Artificial Sequence
  Description of Artificial Sequence: Synthetic peptide
  Seed: NSFEVHVCA (TP53 R273H)
NPFEVHVCE

SEQ ID NO: 21717 - protein, 9 aa, Artificial Sequence
  Description of Artificial Sequence: Synthetic peptide
  Seed: NSFEVHVCA (TP53 R273H)
NPFEVHVCF

SEQ ID NO: 21718 - protein, 9 aa, Artificial Sequence
  Description of Artificial Sequence: Synthetic peptide
  Seed: NSFEVHVCA (TP53 R273H)
NPFEVHVCG

SEQ ID NO: 21719 - protein, 9 aa, Artificial Sequence
  Description of Artificial Sequence: Synthetic peptide
  Seed: NSFEVHVCA (TP53 R273H)
NPFEVHVCH

SEQ ID NO: 21720 - protein, 9 aa, Artificial Sequence
  Description of Artificial Sequence: Synthetic peptide
  Seed: NSFEVHVCA (TP53 R273H)
NPFEVHVCK

SEQ ID NO: 21721 - protein, 9 aa, Artificial Sequence
  Description of Artificial Sequence: Synthetic peptide
  Seed: NSFEVHVCA (TP53 R273H)
NPFEVHVCL

SEQ ID NO: 21722 - protein, 9 aa, Artificial Sequence
  Description of Artificial Sequence: Synthetic peptide
  Seed: NSFEVHVCA (TP53 R273H)
NPFEVHVCM

SEQ ID NO: 21723 - protein, 9 aa, Artificial Sequence
  Description of Artificial Sequence: Synthetic peptide
  Seed: NSFEVHVCA (TP53 R273H)
NPFEVHVCN

SEQ ID NO: 21724 - protein, 9 aa, Artificial Sequence
  Description of Artificial Sequence: Synthetic peptide
  Seed: NSFEVHVCA (TP53 R273H)
NPFEVHVCQ

SEQ ID NO: 21725 - protein, 9 aa, Artificial Sequence
  Description of Artificial Sequence: Synthetic peptide
  Seed: NSFEVHVCA (TP53 R273H)
NPFEVHVCR

SEQ ID NO: 21726 - protein, 9 aa, Artificial Sequence
  Description of Artificial Sequence: Synthetic peptide
  Seed: NSFEVHVCA (TP53 R273H)
NPFEVHVCY

SEQ ID NO: 21727 - protein, 9 aa, Artificial Sequence
  Description of Artificial Sequence: Synthetic peptide
  Seed: SFEVHVCAC (TP53 R273H)
SAEVHVCAF

SEQ ID NO: 21728 - protein, 9 aa, Artificial Sequence
  Description of Artificial Sequence: Synthetic peptide
  Seed: SFEVHVCAC (TP53 R273H)
SAEVHVCAI

SEQ ID NO: 21729 - protein, 9 aa, Artificial Sequence
  Description of Artificial Sequence: Synthetic peptide
  Seed: SFEVHVCAC (TP53 R273H)
SAEVHVCAL

SEQ ID NO: 21730 - protein, 9 aa, Artificial Sequence
  Description of Artificial Sequence: Synthetic peptide
  Seed: SFEVHVCAC (TP53 R273H)
SAEVHVCAM

SEQ ID NO: 21731 - protein, 9 aa, Artificial Sequence
  Description of Artificial Sequence: Synthetic peptide
  Seed: SFEVHVCAC (TP53 R273H)
SAEVHVCAV

SEQ ID NO: 21732 - protein, 9 aa, Artificial Sequence
  Description of Artificial Sequence: Synthetic peptide
  Seed: SFEVHVCAC (TP53 R273H)
SCEVHVCAF

SEQ ID NO: 21733 - protein, 9 aa, Artificial Sequence
  Description of Artificial Sequence: Synthetic peptide
  Seed: SFEVHVCAC (TP53 R273H)
SCEVHVCAI

SEQ ID NO: 21734 - protein, 9 aa, Artificial Sequence
  Description of Artificial Sequence: Synthetic peptide
  Seed: SFEVHVCAC (TP53 R273H)
SCEVHVCAL

SEQ ID NO: 21735 - protein, 9 aa, Artificial Sequence
  Description of Artificial Sequence: Synthetic peptide
  Seed: SFEVHVCAC (TP53 R273H)
SCEVHVCAM

SEQ ID NO: 21736 - protein, 9 aa, Artificial Sequence
  Description of Artificial Sequence: Synthetic peptide
  Seed: SFEVHVCAC (TP53 R273H)
SDEVHVCAF

SEQ ID NO: 21737 - protein, 9 aa, Artificial Sequence
  Description of Artificial Sequence: Synthetic peptide
  Seed: SFEVHVCAC (TP53 R273H)
SDEVHVCAI

SEQ ID NO: 21738 - protein, 9 aa, Artificial Sequence
  Description of Artificial Sequence: Synthetic peptide
  Seed: SFEVHVCAC (TP53 R273H)
SDEVHVCAL

SEQ ID NO: 21739 - protein, 9 aa, Artificial Sequence
  Description of Artificial Sequence: Synthetic peptide
  Seed: SFEVHVCAC (TP53 R273H)
SDEVHVCAM

SEQ ID NO: 21740 - protein, 9 aa, Artificial Sequence
  Description of Artificial Sequence: Synthetic peptide
  Seed: SFEVHVCAC (TP53 R273H)
SDEVHVCAV

SEQ ID NO: 21741 - protein, 9 aa, Artificial Sequence
  Description of Artificial Sequence: Synthetic peptide
  Seed: SFEVHVCAC (TP53 R273H)
SEEVHVCAF

SEQ ID NO: 21742 - protein, 9 aa, Artificial Sequence
  Description of Artificial Sequence: Synthetic peptide
  Seed: SFEVHVCAC (TP53 R273H)
SEEVHVCAI

SEQ ID NO: 21743 - protein, 9 aa, Artificial Sequence
  Description of Artificial Sequence: Synthetic peptide
  Seed: SFEVHVCAC (TP53 R273H)
SEEVHVCAL

SEQ ID NO: 21744 - protein, 9 aa, Artificial Sequence
  Description of Artificial Sequence: Synthetic peptide
  Seed: SFEVHVCAC (TP53 R273H)
SEEVHVCAM

SEQ ID NO: 21745 - protein, 9 aa, Artificial Sequence
  Description of Artificial Sequence: Synthetic peptide
  Seed: SFEVHVCAC (TP53 R273H)
SEEVHVCAV

SEQ ID NO: 21746 - protein, 9 aa, Artificial Sequence
  Description of Artificial Sequence: Synthetic peptide
  Seed: SFEVHVCAC (TP53 R273H)
SFEVHVCAA

SEQ ID NO: 21747 - protein, 9 aa, Artificial Sequence
  Description of Artificial Sequence: Synthetic peptide
  Seed: SFEVHVCAC (TP53 R273H)
SFEVHVCAF

SEQ ID NO: 21748 - protein, 9 aa, Artificial Sequence
  Description of Artificial Sequence: Synthetic peptide
  Seed: SFEVHVCAC (TP53 R273H)
SFEVHVCAI

SEQ ID NO: 21749 - protein, 9 aa, Artificial Sequence
  Description of Artificial Sequence: Synthetic peptide
  Seed: SFEVHVCAC (TP53 R273H)
SFEVHVCAL

SEQ ID NO: 21750 - protein, 9 aa, Artificial Sequence
  Description of Artificial Sequence: Synthetic peptide
  Seed: SFEVHVCAC (TP53 R273H)
SFEVHVCAM

SEQ ID NO: 21751 - protein, 9 aa, Artificial Sequence
  Description of Artificial Sequence: Synthetic peptide
  Seed: SFEVHVCAC (TP53 R273H)
SFEVHVCAV

SEQ ID NO: 21752 - protein, 9 aa, Artificial Sequence
  Description of Artificial Sequence: Synthetic peptide
  Seed: SFEVHVCAC (TP53 R273H)
SFEVHVCAW

SEQ ID NO: 21753 - protein, 9 aa, Artificial Sequence
  Description of Artificial Sequence: Synthetic peptide
  Seed: SFEVHVCAC (TP53 R273H)
SFEVHVCAY

SEQ ID NO: 21754 - protein, 9 aa, Artificial Sequence
  Description of Artificial Sequence: Synthetic peptide
  Seed: SFEVHVCAC (TP53 R273H)
SGEVHVCAF

SEQ ID NO: 21755 - protein, 9 aa, Artificial Sequence
  Description of Artificial Sequence: Synthetic peptide
  Seed: SFEVHVCAC (TP53 R273H)
SGEVHVCAI

SEQ ID NO: 21756 - protein, 9 aa, Artificial Sequence
  Description of Artificial Sequence: Synthetic peptide
  Seed: SFEVHVCAC (TP53 R273H)
SGEVHVCAL

SEQ ID NO: 21757 - protein, 9 aa, Artificial Sequence
  Description of Artificial Sequence: Synthetic peptide
  Seed: SFEVHVCAC (TP53 R273H)
SGEVHVCAM

SEQ ID NO: 21758 - protein, 9 aa, Artificial Sequence
  Description of Artificial Sequence: Synthetic peptide
  Seed: SFEVHVCAC (TP53 R273H)
SGEVHVCAV

SEQ ID NO: 21759 - protein, 9 aa, Artificial Sequence
  Description of Artificial Sequence: Synthetic peptide
  Seed: SFEVHVCAC (TP53 R273H)
SHEVHVCAF

SEQ ID NO: 21760 - protein, 9 aa, Artificial Sequence
  Description of Artificial Sequence: Synthetic peptide
  Seed: SFEVHVCAC (TP53 R273H)
SHEVHVCAI

SEQ ID NO: 21761 - protein, 9 aa, Artificial Sequence
  Description of Artificial Sequence: Synthetic peptide
  Seed: SFEVHVCAC (TP53 R273H)
SHEVHVCAL

SEQ ID NO: 21762 - protein, 9 aa, Artificial Sequence
  Description of Artificial Sequence: Synthetic peptide
  Seed: SFEVHVCAC (TP53 R273H)
SHEVHVCAM

SEQ ID NO: 21763 - protein, 9 aa, Artificial Sequence
  Description of Artificial Sequence: Synthetic peptide
  Seed: SFEVHVCAC (TP53 R273H)
SHEVHVCAV

SEQ ID NO: 21764 - protein, 9 aa, Artificial Sequence
  Description of Artificial Sequence: Synthetic peptide
  Seed: SFEVHVCAC (TP53 R273H)
SIEVHVCAF

SEQ ID NO: 21765 - protein, 9 aa, Artificial Sequence
  Description of Artificial Sequence: Synthetic peptide
  Seed: SFEVHVCAC (TP53 R273H)
SIEVHVCAI

SEQ ID NO: 21766 - protein, 9 aa, Artificial Sequence
  Description of Artificial Sequence: Synthetic peptide
  Seed: SFEVHVCAC (TP53 R273H)
SIEVHVCAL

SEQ ID NO: 21767 - protein, 9 aa, Artificial Sequence
  Description of Artificial Sequence: Synthetic peptide
  Seed: SFEVHVCAC (TP53 R273H)
SIEVHVCAM

SEQ ID NO: 21768 - protein, 9 aa, Artificial Sequence
  Description of Artificial Sequence: Synthetic peptide
  Seed: SFEVHVCAC (TP53 R273H)
SIEVHVCAV

SEQ ID NO: 21769 - protein, 9 aa, Artificial Sequence
  Description of Artificial Sequence: Synthetic peptide
  Seed: SFEVHVCAC (TP53 R273H)
SKEVHVCAF

SEQ ID NO: 21770 - protein, 9 aa, Artificial Sequence
  Description of Artificial Sequence: Synthetic peptide
  Seed: SFEVHVCAC (TP53 R273H)
SKEVHVCAI

SEQ ID NO: 21771 - protein, 9 aa, Artificial Sequence
  Description of Artificial Sequence: Synthetic peptide
  Seed: SFEVHVCAC (TP53 R273H)
SKEVHVCAL

SEQ ID NO: 21772 - protein, 9 aa, Artificial Sequence
  Description of Artificial Sequence: Synthetic peptide
  Seed: SFEVHVCAC (TP53 R273H)
SKEVHVCAM

SEQ ID NO: 21773 - protein, 9 aa, Artificial Sequence
  Description of Artificial Sequence: Synthetic peptide
  Seed: SFEVHVCAC (TP53 R273H)
SKEVHVCAV

SEQ ID NO: 21774 - protein, 9 aa, Artificial Sequence
  Description of Artificial Sequence: Synthetic peptide
  Seed: SFEVHVCAC (TP53 R273H)
SLEVHVCAF

SEQ ID NO: 21775 - protein, 9 aa, Artificial Sequence
  Description of Artificial Sequence: Synthetic peptide
  Seed: SFEVHVCAC (TP53 R273H)
SLEVHVCAI

SEQ ID NO: 21776 - protein, 9 aa, Artificial Sequence
  Description of Artificial Sequence: Synthetic peptide
  Seed: SFEVHVCAC (TP53 R273H)
SLEVHVCAL

SEQ ID NO: 21777 - protein, 9 aa, Artificial Sequence
  Description of Artificial Sequence: Synthetic peptide
  Seed: SFEVHVCAC (TP53 R273H)
SLEVHVCAM

SEQ ID NO: 21778 - protein, 9 aa, Artificial Sequence
  Description of Artificial Sequence: Synthetic peptide
  Seed: SFEVHVCAC (TP53 R273H)
SLEVHVCAV

SEQ ID NO: 21779 - protein, 9 aa, Artificial Sequence
  Description of Artificial Sequence: Synthetic peptide
  Seed: SFEVHVCAC (TP53 R273H)
SMEVHVCAF

SEQ ID NO: 21780 - protein, 9 aa, Artificial Sequence
  Description of Artificial Sequence: Synthetic peptide
  Seed: SFEVHVCAC (TP53 R273H)
SMEVHVCAI

SEQ ID NO: 21781 - protein, 9 aa, Artificial Sequence
  Description of Artificial Sequence: Synthetic peptide
  Seed: SFEVHVCAC (TP53 R273H)
SMEVHVCAL

SEQ ID NO: 21782 - protein, 9 aa, Artificial Sequence
  Description of Artificial Sequence: Synthetic peptide
  Seed: SFEVHVCAC (TP53 R273H)
SMEVHVCAM

SEQ ID NO: 21783 - protein, 9 aa, Artificial Sequence
  Description of Artificial Sequence: Synthetic peptide
  Seed: SFEVHVCAC (TP53 R273H)
SMEVHVCAV

SEQ ID NO: 21784 - protein, 9 aa, Artificial Sequence
  Description of Artificial Sequence: Synthetic peptide
  Seed: SFEVHVCAC (TP53 R273H)
SNEVHVCAF

SEQ ID NO: 21785 - protein, 9 aa, Artificial Sequence
  Description of Artificial Sequence: Synthetic peptide
  Seed: SFEVHVCAC (TP53 R273H)
SNEVHVCAI

SEQ ID NO: 21786 - protein, 9 aa, Artificial Sequence
  Description of Artificial Sequence: Synthetic peptide
  Seed: SFEVHVCAC (TP53 R273H)
SNEVHVCAL

SEQ ID NO: 21787 - protein, 9 aa, Artificial Sequence
  Description of Artificial Sequence: Synthetic peptide
  Seed: SFEVHVCAC (TP53 R273H)
SNEVHVCAM

SEQ ID NO: 21788 - protein, 9 aa, Artificial Sequence
  Description of Artificial Sequence: Synthetic peptide
  Seed: SFEVHVCAC (TP53 R273H)
SNEVHVCAV

SEQ ID NO: 21789 - protein, 9 aa, Artificial Sequence
  Description of Artificial Sequence: Synthetic peptide
  Seed: SFEVHVCAC (TP53 R273H)
SPEVHVCAF

SEQ ID NO: 21790 - protein, 9 aa, Artificial Sequence
  Description of Artificial Sequence: Synthetic peptide
  Seed: SFEVHVCAC (TP53 R273H)
SPEVHVCAL

SEQ ID NO: 21791 - protein, 9 aa, Artificial Sequence
  Description of Artificial Sequence: Synthetic peptide
  Seed: SFEVHVCAC (TP53 R273H)
SPEVHVCAM

SEQ ID NO: 21792 - protein, 9 aa, Artificial Sequence
  Description of Artificial Sequence: Synthetic peptide
  Seed: SFEVHVCAC (TP53 R273H)
SQEVHVCAF

SEQ ID NO: 21793 - protein, 9 aa, Artificial Sequence
  Description of Artificial Sequence: Synthetic peptide
  Seed: SFEVHVCAC (TP53 R273H)
SQEVHVCAI

SEQ ID NO: 21794 - protein, 9 aa, Artificial Sequence
  Description of Artificial Sequence: Synthetic peptide
  Seed: SFEVHVCAC (TP53 R273H)
SQEVHVCAL

SEQ ID NO: 21795 - protein, 9 aa, Artificial Sequence
  Description of Artificial Sequence: Synthetic peptide
  Seed: SFEVHVCAC (TP53 R273H)
SQEVHVCAM

SEQ ID NO: 21796 - protein, 9 aa, Artificial Sequence
  Description of Artificial Sequence: Synthetic peptide
  Seed: SFEVHVCAC (TP53 R273H)
SQEVHVCAV

SEQ ID NO: 21797 - protein, 9 aa, Artificial Sequence
  Description of Artificial Sequence: Synthetic peptide
  Seed: SFEVHVCAC (TP53 R273H)
SREVHVCAA

SEQ ID NO: 21798 - protein, 9 aa, Artificial Sequence
  Description of Artificial Sequence: Synthetic peptide
  Seed: SFEVHVCAC (TP53 R273H)
SREVHVCAC

SEQ ID NO: 21799 - protein, 9 aa, Artificial Sequence
  Description of Artificial Sequence: Synthetic peptide
  Seed: SFEVHVCAC (TP53 R273H)
SREVHVCAF

SEQ ID NO: 21800 - protein, 9 aa, Artificial Sequence
  Description of Artificial Sequence: Synthetic peptide
  Seed: SFEVHVCAC (TP53 R273H)
SREVHVCAI

SEQ ID NO: 21801 - protein, 9 aa, Artificial Sequence
  Description of Artificial Sequence: Synthetic peptide
  Seed: SFEVHVCAC (TP53 R273H)
SREVHVCAL

SEQ ID NO: 21802 - protein, 9 aa, Artificial Sequence
  Description of Artificial Sequence: Synthetic peptide
  Seed: SFEVHVCAC (TP53 R273H)
SREVHVCAM

SEQ ID NO: 21803 - protein, 9 aa, Artificial Sequence
  Description of Artificial Sequence: Synthetic peptide
  Seed: SFEVHVCAC (TP53 R273H)
SREVHVCAV

SEQ ID NO: 21804 - protein, 9 aa, Artificial Sequence
  Description of Artificial Sequence: Synthetic peptide
  Seed: SFEVHVCAC (TP53 R273H)
SREVHVCAY

SEQ ID NO: 21805 - protein, 9 aa, Artificial Sequence
  Description of Artificial Sequence: Synthetic peptide
  Seed: SFEVHVCAC (TP53 R273H)
SSEVHVCAF

SEQ ID NO: 21806 - protein, 9 aa, Artificial Sequence
  Description of Artificial Sequence: Synthetic peptide
  Seed: SFEVHVCAC (TP53 R273H)
SSEVHVCAI

SEQ ID NO: 21807 - protein, 9 aa, Artificial Sequence
  Description of Artificial Sequence: Synthetic peptide
  Seed: SFEVHVCAC (TP53 R273H)
SSEVHVCAL

SEQ ID NO: 21808 - protein, 9 aa, Artificial Sequence
  Description of Artificial Sequence: Synthetic peptide
  Seed: SFEVHVCAC (TP53 R273H)
SSEVHVCAM

SEQ ID NO: 21809 - protein, 9 aa, Artificial Sequence
  Description of Artificial Sequence: Synthetic peptide
  Seed: SFEVHVCAC (TP53 R273H)
SSEVHVCAV

SEQ ID NO: 21810 - protein, 9 aa, Artificial Sequence
  Description of Artificial Sequence: Synthetic peptide
  Seed: SFEVHVCAC (TP53 R273H)
STEVHVCAF

SEQ ID NO: 21811 - protein, 9 aa, Artificial Sequence
  Description of Artificial Sequence: Synthetic peptide
  Seed: SFEVHVCAC (TP53 R273H)
STEVHVCAI

SEQ ID NO: 21812 - protein, 9 aa, Artificial Sequence
  Description of Artificial Sequence: Synthetic peptide
  Seed: SFEVHVCAC (TP53 R273H)
STEVHVCAL

SEQ ID NO: 21813 - protein, 9 aa, Artificial Sequence
  Description of Artificial Sequence: Synthetic peptide
  Seed: SFEVHVCAC (TP53 R273H)
STEVHVCAM

SEQ ID NO: 21814 - protein, 9 aa, Artificial Sequence
  Description of Artificial Sequence: Synthetic peptide
  Seed: SFEVHVCAC (TP53 R273H)
STEVHVCAV

SEQ ID NO: 21815 - protein, 9 aa, Artificial Sequence
  Description of Artificial Sequence: Synthetic peptide
  Seed: SFEVHVCAC (TP53 R273H)
SVEVHVCAF

SEQ ID NO: 21816 - protein, 9 aa, Artificial Sequence
  Description of Artificial Sequence: Synthetic peptide
  Seed: SFEVHVCAC (TP53 R273H)
SVEVHVCAI

SEQ ID NO: 21817 - protein, 9 aa, Artificial Sequence
  Description of Artificial Sequence: Synthetic peptide
  Seed: SFEVHVCAC (TP53 R273H)
SVEVHVCAL

SEQ ID NO: 21818 - protein, 9 aa, Artificial Sequence
  Description of Artificial Sequence: Synthetic peptide
  Seed: SFEVHVCAC (TP53 R273H)
SVEVHVCAM

SEQ ID NO: 21819 - protein, 9 aa, Artificial Sequence
  Description of Artificial Sequence: Synthetic peptide
  Seed: SFEVHVCAC (TP53 R273H)
SVEVHVCAV

SEQ ID NO: 21820 - protein, 9 aa, Artificial Sequence
  Description of Artificial Sequence: Synthetic peptide
  Seed: SFEVHVCAC (TP53 R273H)
SWEVHVCAC

SEQ ID NO: 21821 - protein, 9 aa, Artificial Sequence
  Description of Artificial Sequence: Synthetic peptide
  Seed: SFEVHVCAC (TP53 R273H)
SWEVHVCAF

SEQ ID NO: 21822 - protein, 9 aa, Artificial Sequence
  Description of Artificial Sequence: Synthetic peptide
  Seed: SFEVHVCAC (TP53 R273H)
SWEVHVCAI

SEQ ID NO: 21823 - protein, 9 aa, Artificial Sequence
  Description of Artificial Sequence: Synthetic peptide
  Seed: SFEVHVCAC (TP53 R273H)
SWEVHVCAL

SEQ ID NO: 21824 - protein, 9 aa, Artificial Sequence
  Description of Artificial Sequence: Synthetic peptide
  Seed: SFEVHVCAC (TP53 R273H)
SWEVHVCAM

SEQ ID NO: 21825 - protein, 9 aa, Artificial Sequence
  Description of Artificial Sequence: Synthetic peptide
  Seed: SFEVHVCAC (TP53 R273H)
SWEVHVCAV

SEQ ID NO: 21826 - protein, 9 aa, Artificial Sequence
  Description of Artificial Sequence: Synthetic peptide
  Seed: SFEVHVCAC (TP53 R273H)
SWEVHVCAY

SEQ ID NO: 21827 - protein, 9 aa, Artificial Sequence
  Description of Artificial Sequence: Synthetic peptide
  Seed: SFEVHVCAC (TP53 R273H)
SYEVHVCAA

SEQ ID NO: 21828 - protein, 9 aa, Artificial Sequence
  Description of Artificial Sequence: Synthetic peptide
  Seed: SFEVHVCAC (TP53 R273H)
SYEVHVCAC

SEQ ID NO: 21829 - protein, 9 aa, Artificial Sequence
  Description of Artificial Sequence: Synthetic peptide
  Seed: SFEVHVCAC (TP53 R273H)
SYEVHVCAF

SEQ ID NO: 21830 - protein, 9 aa, Artificial Sequence
  Description of Artificial Sequence: Synthetic peptide
  Seed: SFEVHVCAC (TP53 R273H)
SYEVHVCAI

SEQ ID NO: 21831 - protein, 9 aa, Artificial Sequence
  Description of Artificial Sequence: Synthetic peptide
  Seed: SFEVHVCAC (TP53 R273H)
SYEVHVCAM

SEQ ID NO: 21832 - protein, 9 aa, Artificial Sequence
  Description of Artificial Sequence: Synthetic peptide
  Seed: SFEVHVCAC (TP53 R273H)
SYEVHVCAV

SEQ ID NO: 21833 - protein, 9 aa, Artificial Sequence
  Description of Artificial Sequence: Synthetic peptide
  Seed: SFEVHVCAC (TP53 R273H)
SYEVHVCAW

SEQ ID NO: 21834 - protein, 9 aa, Artificial Sequence
  Description of Artificial Sequence: Synthetic peptide
  Seed: SFEVHVCAC (TP53 R273H)
SYEVHVCAY

SEQ ID NO: 21835 - protein, 9 aa, Homo sapiens
  Native (TP53 R273H)
FEVHVCACP

SEQ ID NO: 21836 - protein, 9 aa, Homo sapiens
  Native (TP53 R273H)
GRNSFEVHV

SEQ ID NO: 21837 - protein, 10 aa, Homo sapiens
  Native (TP53 R273H)
HVCACPGRDR

SEQ ID NO: 21838 - protein, 11 aa, Homo sapiens
  Native (TP53 R273H)
LLGRNSFEVHV

SEQ ID NO: 21839 - protein, 9 aa, Homo sapiens
  Native (TP53 R273H)
NSFEVHVCA

SEQ ID NO: 21840 - protein, 8 aa, Homo sapiens
  Native (TP53 R273H)
FEVHVCAC

SEQ ID NO: 21841 - protein, 10 aa, Homo sapiens
  Native (TP53 R273H)
GRNSFEVHVC

SEQ ID NO: 21842 - protein, 11 aa, Homo sapiens
  Native (TP53 R273H)
GRNSFEVHVCA

SEQ ID NO: 21843 - protein, 8 aa, Homo sapiens
  Native (TP53 R273H)
HVCACPGR

SEQ ID NO: 21844 - protein, 11 aa, Homo sapiens
  Native (TP53 R273H)
HVCACPGRDRR

SEQ ID NO: 21845 - protein, 9 aa, Homo sapiens
  Native (TP53 R273H)
SFEVHVCAC

SEQ ID NO: 21846 - protein, 9 aa, Artificial Sequence
  Description of Artificial Sequence: Synthetic peptide
  Seed: CACPGRDWR (TP53 R282W)
CFCPGRDWK

SEQ ID NO: 21847 - protein, 9 aa, Artificial Sequence
  Description of Artificial Sequence: Synthetic peptide
  Seed: CACPGRDWR (TP53 R282W)
CFCPGRDWR

SEQ ID NO: 21848 - protein, 9 aa, Artificial Sequence
  Description of Artificial Sequence: Synthetic peptide
  Seed: CACPGRDWR (TP53 R282W)
CGCPGRDWR

SEQ ID NO: 21849 - protein, 9 aa, Artificial Sequence
  Description of Artificial Sequence: Synthetic peptide
  Seed: CACPGRDWR (TP53 R282W)
CICPGRDWK

SEQ ID NO: 21850 - protein, 9 aa, Artificial Sequence
  Description of Artificial Sequence: Synthetic peptide
  Seed: CACPGRDWR (TP53 R282W)
CICPGRDWR

SEQ ID NO: 21851 - protein, 9 aa, Artificial Sequence
  Description of Artificial Sequence: Synthetic peptide
  Seed: CACPGRDWR (TP53 R282W)
CLCPGRDWK

SEQ ID NO: 21852 - protein, 9 aa, Artificial Sequence
  Description of Artificial Sequence: Synthetic peptide
  Seed: CACPGRDWR (TP53 R282W)
CLCPGRDWR

SEQ ID NO: 21853 - protein, 9 aa, Artificial Sequence
  Description of Artificial Sequence: Synthetic peptide
  Seed: CACPGRDWR (TP53 R282W)
CMCPGRDWK

SEQ ID NO: 21854 - protein, 9 aa, Artificial Sequence
  Description of Artificial Sequence: Synthetic peptide
  Seed: CACPGRDWR (TP53 R282W)
CMCPGRDWR

SEQ ID NO: 21855 - protein, 9 aa, Artificial Sequence
  Description of Artificial Sequence: Synthetic peptide
  Seed: CACPGRDWR (TP53 R282W)
CNCPGRDWR

SEQ ID NO: 21856 - protein, 9 aa, Artificial Sequence
  Description of Artificial Sequence: Synthetic peptide
  Seed: CACPGRDWR (TP53 R282W)
CQCPGRDWK

SEQ ID NO: 21857 - protein, 9 aa, Artificial Sequence
  Description of Artificial Sequence: Synthetic peptide
  Seed: CACPGRDWR (TP53 R282W)
CQCPGRDWR

SEQ ID NO: 21858 - protein, 9 aa, Artificial Sequence
  Description of Artificial Sequence: Synthetic peptide
  Seed: CACPGRDWR (TP53 R282W)
CSCPGRDWK

SEQ ID NO: 21859 - protein, 9 aa, Artificial Sequence
  Description of Artificial Sequence: Synthetic peptide
  Seed: CACPGRDWR (TP53 R282W)
CSCPGRDWR

SEQ ID NO: 21860 - protein, 9 aa, Artificial Sequence
  Description of Artificial Sequence: Synthetic peptide
  Seed: CACPGRDWR (TP53 R282W)
CTCPGRDWK

SEQ ID NO: 21861 - protein, 9 aa, Artificial Sequence
  Description of Artificial Sequence: Synthetic peptide
  Seed: CACPGRDWR (TP53 R282W)
CVCPGRDWK

SEQ ID NO: 21862 - protein, 9 aa, Artificial Sequence
  Description of Artificial Sequence: Synthetic peptide
  Seed: CACPGRDWR (TP53 R282W)
CVCPGRDWR

SEQ ID NO: 21863 - protein, 9 aa, Artificial Sequence
  Description of Artificial Sequence: Synthetic peptide
  Seed: CACPGRDWR (TP53 R282W)
CWCPGRDWK

SEQ ID NO: 21864 - protein, 9 aa, Artificial Sequence
  Description of Artificial Sequence: Synthetic peptide
  Seed: CACPGRDWR (TP53 R282W)
CWCPGRDWR

SEQ ID NO: 21865 - protein, 9 aa, Artificial Sequence
  Description of Artificial Sequence: Synthetic peptide
  Seed: CACPGRDWR (TP53 R282W)
CYCPGRDWK

SEQ ID NO: 21866 - protein, 9 aa, Artificial Sequence
  Description of Artificial Sequence: Synthetic peptide
  Seed: CACPGRDWR (TP53 R282W)
CYCPGRDWR

SEQ ID NO: 21867 - protein, 11 aa, Artificial Sequence
  Description of Artificial Sequence: Synthetic peptide
  Seed: RVCACPGRDWR (TP53 R282W)
RACACPGRDWR

SEQ ID NO: 21868 - protein, 11 aa, Artificial Sequence
  Description of Artificial Sequence: Synthetic peptide
  Seed: RVCACPGRDWR (TP53 R282W)
RFCACPGRDWK

SEQ ID NO: 21869 - protein, 11 aa, Artificial Sequence
  Description of Artificial Sequence: Synthetic peptide
  Seed: RVCACPGRDWR (TP53 R282W)
RFCACPGRDWR

SEQ ID NO: 21870 - protein, 11 aa, Artificial Sequence
  Description of Artificial Sequence: Synthetic peptide
  Seed: RVCACPGRDWR (TP53 R282W)
RGCACPGRDWR

SEQ ID NO: 21871 - protein, 11 aa, Artificial Sequence
  Description of Artificial Sequence: Synthetic peptide
  Seed: RVCACPGRDWR (TP53 R282W)
RICACPGRDWR

SEQ ID NO: 21872 - protein, 11 aa, Artificial Sequence
  Description of Artificial Sequence: Synthetic peptide
  Seed: RVCACPGRDWR (TP53 R282W)
RLCACPGRDWR

SEQ ID NO: 21873 - protein, 11 aa, Artificial Sequence
  Description of Artificial Sequence: Synthetic peptide
  Seed: RVCACPGRDWR (TP53 R282W)
RMCACPGRDWK

SEQ ID NO: 21874 - protein, 11 aa, Artificial Sequence
  Description of Artificial Sequence: Synthetic peptide
  Seed: RVCACPGRDWR (TP53 R282W)
RNCACPGRDWR

SEQ ID NO: 21875 - protein, 11 aa, Artificial Sequence
  Description of Artificial Sequence: Synthetic peptide
  Seed: RVCACPGRDWR (TP53 R282W)
RQCACPGRDWR

SEQ ID NO: 21876 - protein, 11 aa, Artificial Sequence
  Description of Artificial Sequence: Synthetic peptide
  Seed: RVCACPGRDWR (TP53 R282W)
RSCACPGRDWR

SEQ ID NO: 21877 - protein, 11 aa, Artificial Sequence
  Description of Artificial Sequence: Synthetic peptide
  Seed: RVCACPGRDWR (TP53 R282W)
RTCACPGRDWK

SEQ ID NO: 21878 - protein, 11 aa, Artificial Sequence
  Description of Artificial Sequence: Synthetic peptide
  Seed: RVCACPGRDWR (TP53 R282W)
RTCACPGRDWR

SEQ ID NO: 21879 - protein, 11 aa, Artificial Sequence
  Description of Artificial Sequence: Synthetic peptide
  Seed: RVCACPGRDWR (TP53 R282W)
RVCACPGRDWK

SEQ ID NO: 21880 - protein, 11 aa, Artificial Sequence
  Description of Artificial Sequence: Synthetic peptide
  Seed: RVCACPGRDWR (TP53 R282W)
RWCACPGRDWR

SEQ ID NO: 21881 - protein, 11 aa, Artificial Sequence
  Description of Artificial Sequence: Synthetic peptide
  Seed: RVCACPGRDWR (TP53 R282W)
RYCACPGRDWK

SEQ ID NO: 21882 - protein, 11 aa, Artificial Sequence
  Description of Artificial Sequence: Synthetic peptide
  Seed: RVCACPGRDWR (TP53 R282W)
RYCACPGRDWR

SEQ ID NO: 21883 - protein, 9 aa, Artificial Sequence
  Description of Artificial Sequence: Synthetic peptide
  Seed: CACPGRDWR (TP53 R282W)
CACPGRDWK

SEQ ID NO: 21884 - protein, 11 aa, Artificial Sequence
  Description of Artificial Sequence: Synthetic peptide
  Seed: GRDWRTEEENL (TP53 R282W)
GRDWRTEEENF

SEQ ID NO: 21885 - protein, 11 aa, Artificial Sequence
  Description of Artificial Sequence: Synthetic peptide
  Seed: GRDWRTEEENL (TP53 R282W)
GRDWRTEEENI

SEQ ID NO: 21886 - protein, 11 aa, Artificial Sequence
  Description of Artificial Sequence: Synthetic peptide
  Seed: GRDWRTEEENL (TP53 R282W)
GRDWRTEEENK

SEQ ID NO: 21887 - protein, 11 aa, Artificial Sequence
  Description of Artificial Sequence: Synthetic peptide
  Seed: GRDWRTEEENL (TP53 R282W)
GRDWRTEEENM

SEQ ID NO: 21888 - protein, 11 aa, Artificial Sequence
  Description of Artificial Sequence: Synthetic peptide
  Seed: GRDWRTEEENL (TP53 R282W)
GRDWRTEEENR

SEQ ID NO: 21889 - protein, 11 aa, Artificial Sequence
  Description of Artificial Sequence: Synthetic peptide
  Seed: GRDWRTEEENL (TP53 R282W)
GRDWRTEEENV

SEQ ID NO: 21890 - protein, 11 aa, Artificial Sequence
  Description of Artificial Sequence: Synthetic peptide
  Seed: GRDWRTEEENL (TP53 R282W)
GRDWRTEEENW

SEQ ID NO: 21891 - protein, 11 aa, Artificial Sequence
  Description of Artificial Sequence: Synthetic peptide
  Seed: GRDWRTEEENL (TP53 R282W)
GRDWRTEEENY

SEQ ID NO: 21892 - protein, 11 aa, Artificial Sequence
  Description of Artificial Sequence: Synthetic peptide
  Seed: GRDWRTEEENL (TP53 R282W)
GYDWRTEEENL

SEQ ID NO: 21893 - protein, 10 aa, Artificial Sequence
  Description of Artificial Sequence: Synthetic peptide
  Seed: RDWRTEEENL (TP53 R282W)
RDWRTEEENF

SEQ ID NO: 21894 - protein, 10 aa, Artificial Sequence
  Description of Artificial Sequence: Synthetic peptide
  Seed: RDWRTEEENL (TP53 R282W)
RDWRTEEENM

SEQ ID NO: 21895 - protein, 10 aa, Artificial Sequence
  Description of Artificial Sequence: Synthetic peptide
  Seed: RDWRTEEENL (TP53 R282W)
REWRTEEENA

SEQ ID NO: 21896 - protein, 10 aa, Artificial Sequence
  Description of Artificial Sequence: Synthetic peptide
  Seed: RDWRTEEENL (TP53 R282W)
REWRTEEENC

SEQ ID NO: 21897 - protein, 10 aa, Artificial Sequence
  Description of Artificial Sequence: Synthetic peptide
  Seed: RDWRTEEENL (TP53 R282W)
REWRTEEENF

SEQ ID NO: 21898 - protein, 10 aa, Artificial Sequence
  Description of Artificial Sequence: Synthetic peptide
  Seed: RDWRTEEENL (TP53 R282W)
REWRTEEENI

SEQ ID NO: 21899 - protein, 10 aa, Artificial Sequence
  Description of Artificial Sequence: Synthetic peptide
  Seed: RDWRTEEENL (TP53 R282W)
REWRTEEENM

SEQ ID NO: 21900 - protein, 10 aa, Artificial Sequence
  Description of Artificial Sequence: Synthetic peptide
  Seed: RDWRTEEENL (TP53 R282W)
REWRTEEENP

SEQ ID NO: 21901 - protein, 10 aa, Artificial Sequence
  Description of Artificial Sequence: Synthetic peptide
  Seed: RDWRTEEENL (TP53 R282W)
REWRTEEENT

SEQ ID NO: 21902 - protein, 10 aa, Artificial Sequence
  Description of Artificial Sequence: Synthetic peptide
  Seed: RDWRTEEENL (TP53 R282W)
REWRTEEENV

SEQ ID NO: 21903 - protein, 10 aa, Artificial Sequence
  Description of Artificial Sequence: Synthetic peptide
  Seed: RDWRTEEENL (TP53 R282W)
REWRTEEENW

SEQ ID NO: 21904 - protein, 10 aa, Artificial Sequence
  Description of Artificial Sequence: Synthetic peptide
  Seed: RDWRTEEENL (TP53 R282W)
REWRTEEENY

SEQ ID NO: 21905 - protein, 11 aa, Artificial Sequence
  Description of Artificial Sequence: Synthetic peptide
  Seed: RVCACPGRDWR (TP53 R282W)
RICACPGRDWK

SEQ ID NO: 21906 - protein, 11 aa, Artificial Sequence
  Description of Artificial Sequence: Synthetic peptide
  Seed: RVCACPGRDWR (TP53 R282W)
RLCACPGRDWK

SEQ ID NO: 21907 - protein, 10 aa, Artificial Sequence
  Description of Artificial Sequence: Synthetic peptide
  Seed: RDWRTEEENL (TP53 R282W)
RQWRTEEENF

SEQ ID NO: 21908 - protein, 10 aa, Artificial Sequence
  Description of Artificial Sequence: Synthetic peptide
  Seed: RDWRTEEENL (TP53 R282W)
RQWRTEEENL

SEQ ID NO: 21909 - protein, 9 aa, Artificial Sequence
  Description of Artificial Sequence: Synthetic peptide
  Seed: WRTEEENLR (TP53 R282W)
WRTEEENLF

SEQ ID NO: 21910 - protein, 9 aa, Artificial Sequence
  Description of Artificial Sequence: Synthetic peptide
  Seed: WRTEEENLR (TP53 R282W)
WRTEEENLH

SEQ ID NO: 21911 - protein, 9 aa, Artificial Sequence
  Description of Artificial Sequence: Synthetic peptide
  Seed: WRTEEENLR (TP53 R282W)
WRTEEENLI

SEQ ID NO: 21912 - protein, 9 aa, Artificial Sequence
  Description of Artificial Sequence: Synthetic peptide
  Seed: WRTEEENLR (TP53 R282W)
WRTEEENLK

SEQ ID NO: 21913 - protein, 9 aa, Artificial Sequence
  Description of Artificial Sequence: Synthetic peptide
  Seed: WRTEEENLR (TP53 R282W)
WRTEEENLL

SEQ ID NO: 21914 - protein, 9 aa, Artificial Sequence
  Description of Artificial Sequence: Synthetic peptide
  Seed: WRTEEENLR (TP53 R282W)
WRTEEENLM

SEQ ID NO: 21915 - protein, 10 aa, Artificial Sequence
  Description of Artificial Sequence: Synthetic peptide
  Seed: WRTEEENLRK (TP53 R282W)
WRTEEENLRF

SEQ ID NO: 21916 - protein, 10 aa, Artificial Sequence
  Description of Artificial Sequence: Synthetic peptide
  Seed: WRTEEENLRK (TP53 R282W)
WRTEEENLRI

SEQ ID NO: 21917 - protein, 11 aa, Artificial Sequence
  Description of Artificial Sequence: Synthetic peptide
  Seed: WRTEEENLRKK (TP53 R282W)
WRTEEENLRKF

SEQ ID NO: 21918 - protein, 11 aa, Artificial Sequence
  Description of Artificial Sequence: Synthetic peptide
  Seed: WRTEEENLRKK (TP53 R282W)
WRTEEENLRKH

SEQ ID NO: 21919 - protein, 11 aa, Artificial Sequence
  Description of Artificial Sequence: Synthetic peptide
  Seed: WRTEEENLRKK (TP53 R282W)
WRTEEENLRKI

SEQ ID NO: 21920 - protein, 11 aa, Artificial Sequence
  Description of Artificial Sequence: Synthetic peptide
  Seed: WRTEEENLRKK (TP53 R282W)
WRTEEENLRKL

SEQ ID NO: 21921 - protein, 11 aa, Artificial Sequence
  Description of Artificial Sequence: Synthetic peptide
  Seed: WRTEEENLRKK (TP53 R282W)
WRTEEENLRKM

SEQ ID NO: 21922 - protein, 11 aa, Artificial Sequence
  Description of Artificial Sequence: Synthetic peptide
  Seed: WRTEEENLRKK (TP53 R282W)
WRTEEENLRKR

SEQ ID NO: 21923 - protein, 11 aa, Artificial Sequence
  Description of Artificial Sequence: Synthetic peptide
  Seed: WRTEEENLRKK (TP53 R282W)
WRTEEENLRKV

SEQ ID NO: 21924 - protein, 11 aa, Artificial Sequence
  Description of Artificial Sequence: Synthetic peptide
  Seed: WRTEEENLRKK (TP53 R282W)
WRTEEENLRKW

SEQ ID NO: 21925 - protein, 11 aa, Artificial Sequence
  Description of Artificial Sequence: Synthetic peptide
  Seed: WRTEEENLRKK (TP53 R282W)
WRTEEENLRKY

SEQ ID NO: 21926 - protein, 10 aa, Artificial Sequence
  Description of Artificial Sequence: Synthetic peptide
  Seed: WRTEEENLRK (TP53 R282W)
WRTEEENLRL

SEQ ID NO: 21927 - protein, 10 aa, Artificial Sequence
  Description of Artificial Sequence: Synthetic peptide
  Seed: WRTEEENLRK (TP53 R282W)
WRTEEENLRM

SEQ ID NO: 21928 - protein, 10 aa, Artificial Sequence
  Description of Artificial Sequence: Synthetic peptide
  Seed: WRTEEENLRK (TP53 R282W)
WRTEEENLRR

SEQ ID NO: 21929 - protein, 10 aa, Artificial Sequence
  Description of Artificial Sequence: Synthetic peptide
  Seed: WRTEEENLRK (TP53 R282W)
WRTEEENLRW

SEQ ID NO: 21930 - protein, 10 aa, Artificial Sequence
  Description of Artificial Sequence: Synthetic peptide
  Seed: WRTEEENLRK (TP53 R282W)
WRTEEENLRY

SEQ ID NO: 21931 - protein, 9 aa, Artificial Sequence
  Description of Artificial Sequence: Synthetic peptide
  Seed: WRTEEENLR (TP53 R282W)
WRTEEENLV

SEQ ID NO: 21932 - protein, 9 aa, Artificial Sequence
  Description of Artificial Sequence: Synthetic peptide
  Seed: WRTEEENLR (TP53 R282W)
WRTEEENLW

SEQ ID NO: 21933 - protein, 9 aa, Artificial Sequence
  Description of Artificial Sequence: Synthetic peptide
  Seed: WRTEEENLR (TP53 R282W)
WRTEEENLY

SEQ ID NO: 21934 - protein, 9 aa, Homo sapiens
  Native (TP53 R282W)
CACPGRDWR

SEQ ID NO: 21935 - protein, 11 aa, Homo sapiens
  Native (TP53 R282W)
RVCACPGRDWR

SEQ ID NO: 21936 - protein, 11 aa, Homo sapiens
  Native (TP53 R282W)
GRDWRTEEENL

SEQ ID NO: 21937 - protein, 10 aa, Homo sapiens
  Native (TP53 R282W)
RDWRTEEENL

SEQ ID NO: 21938 - protein, 9 aa, Homo sapiens
  Native (TP53 R282W)
WRTEEENLR

SEQ ID NO: 21939 - protein, 10 aa, Homo sapiens
  Native (TP53 R282W)
WRTEEENLRK

SEQ ID NO: 21940 - protein, 11 aa, Homo sapiens
  Native (TP53 R282W)
WRTEEENLRKK

SEQ ID NO: 21941 - protein, 9 aa, Artificial Sequence
  Description of Artificial Sequence: Synthetic peptide
  Seed: VVPCEPPEV (TP53 Y220C)
VIPCEPPEI

SEQ ID NO: 21942 - protein, 9 aa, Artificial Sequence
  Description of Artificial Sequence: Synthetic peptide
  Seed: VVPCEPPEV (TP53 Y220C)
VIPCEPPEL

SEQ ID NO: 21943 - protein, 9 aa, Artificial Sequence
  Description of Artificial Sequence: Synthetic peptide
  Seed: VVPCEPPEV (TP53 Y220C)
VIPCEPPEV

SEQ ID NO: 21944 - protein, 10 aa, Artificial Sequence
  Description of Artificial Sequence: Synthetic peptide
  Seed: VVVPCEPPEV (TP53 Y220C)
VIVPCEPPEV

SEQ ID NO: 21945 - protein, 9 aa, Artificial Sequence
  Description of Artificial Sequence: Synthetic peptide
  Seed: VVPCEPPEV (TP53 Y220C)
VLPCEPPEA

SEQ ID NO: 21946 - protein, 9 aa, Artificial Sequence
  Description of Artificial Sequence: Synthetic peptide
  Seed: VVPCEPPEV (TP53 Y220C)
VLPCEPPEC

SEQ ID NO: 21947 - protein, 9 aa, Artificial Sequence
  Description of Artificial Sequence: Synthetic peptide
  Seed: VVPCEPPEV (TP53 Y220C)
VLPCEPPEI

SEQ ID NO: 21948 - protein, 9 aa, Artificial Sequence
  Description of Artificial Sequence: Synthetic peptide
  Seed: VVPCEPPEV (TP53 Y220C)
VLPCEPPEM

SEQ ID NO: 21949 - protein, 10 aa, Artificial Sequence
  Description of Artificial Sequence: Synthetic peptide
  Seed: VVVPCEPPEV (TP53 Y220C)
VLVPCEPPEI

SEQ ID NO: 21950 - protein, 10 aa, Artificial Sequence
  Description of Artificial Sequence: Synthetic peptide
  Seed: VVVPCEPPEV (TP53 Y220C)
VLVPCEPPEV

SEQ ID NO: 21951 - protein, 9 aa, Artificial Sequence
  Description of Artificial Sequence: Synthetic peptide
  Seed: VVPCEPPEV (TP53 Y220C)
VMPCEPPEA

SEQ ID NO: 21952 - protein, 9 aa, Artificial Sequence
  Description of Artificial Sequence: Synthetic peptide
  Seed: VVPCEPPEV (TP53 Y220C)
VMPCEPPEI

SEQ ID NO: 21953 - protein, 9 aa, Artificial Sequence
  Description of Artificial Sequence: Synthetic peptide
  Seed: VVPCEPPEV (TP53 Y220C)
VMPCEPPEL

SEQ ID NO: 21954 - protein, 9 aa, Artificial Sequence
  Description of Artificial Sequence: Synthetic peptide
  Seed: VVPCEPPEV (TP53 Y220C)
VMPCEPPEM

SEQ ID NO: 21955 - protein, 10 aa, Artificial Sequence
  Description of Artificial Sequence: Synthetic peptide
  Seed: VVVPCEPPEV (TP53 Y220C)
VMVPCEPPEV

SEQ ID NO: 21956 - protein, 9 aa, Artificial Sequence
  Description of Artificial Sequence: Synthetic peptide
  Seed: VVPCEPPEV (TP53 Y220C)
VQPCEPPEV

SEQ ID NO: 21957 - protein, 10 aa, Artificial Sequence
  Description of Artificial Sequence: Synthetic peptide
  Seed: VVVPCEPPEV (TP53 Y220C)
VQVPCEPPEV

SEQ ID NO: 21958 - protein, 9 aa, Artificial Sequence
  Description of Artificial Sequence: Synthetic peptide
  Seed: VVPCEPPEV (TP53 Y220C)
VTPCEPPEV

SEQ ID NO: 21959 - protein, 9 aa, Artificial Sequence
  Description of Artificial Sequence: Synthetic peptide
  Seed: VVPCEPPEV (TP53 Y220C)
VVPCEPPEI

SEQ ID NO: 21960 - protein, 10 aa, Artificial Sequence
  Description of Artificial Sequence: Synthetic peptide
  Seed: CEPPEVGSDC (TP53 Y220C)
CEPPEVGSDA

SEQ ID NO: 21961 - protein, 11 aa, Artificial Sequence
  Description of Artificial Sequence: Synthetic peptide
  Seed: CEPPEVGSDCT (TP53 Y220C)
CEPPEVGSDCA

SEQ ID NO: 21962 - protein, 11 aa, Artificial Sequence
  Description of Artificial Sequence: Synthetic peptide
  Seed: CEPPEVGSDCT (TP53 Y220C)
CEPPEVGSDCC

SEQ ID NO: 21963 - protein, 11 aa, Artificial Sequence
  Description of Artificial Sequence: Synthetic peptide
  Seed: CEPPEVGSDCT (TP53 Y220C)
CEPPEVGSDCF

SEQ ID NO: 21964 - protein, 11 aa, Artificial Sequence
  Description of Artificial Sequence: Synthetic peptide
  Seed: CEPPEVGSDCT (TP53 Y220C)
CEPPEVGSDCG

SEQ ID NO: 21965 - protein, 11 aa, Artificial Sequence
  Description of Artificial Sequence: Synthetic peptide
  Seed: CEPPEVGSDCT (TP53 Y220C)
CEPPEVGSDCI

SEQ ID NO: 21966 - protein, 11 aa, Artificial Sequence
  Description of Artificial Sequence: Synthetic peptide
  Seed: CEPPEVGSDCT (TP53 Y220C)
CEPPEVGSDCL

SEQ ID NO: 21967 - protein, 11 aa, Artificial Sequence
  Description of Artificial Sequence: Synthetic peptide
  Seed: CEPPEVGSDCT (TP53 Y220C)
CEPPEVGSDCM

SEQ ID NO: 21968 - protein, 11 aa, Artificial Sequence
  Description of Artificial Sequence: Synthetic peptide
  Seed: CEPPEVGSDCT (TP53 Y220C)
CEPPEVGSDCP

SEQ ID NO: 21969 - protein, 11 aa, Artificial Sequence
  Description of Artificial Sequence: Synthetic peptide
  Seed: CEPPEVGSDCT (TP53 Y220C)
CEPPEVGSDCS

SEQ ID NO: 21970 - protein, 11 aa, Artificial Sequence
  Description of Artificial Sequence: Synthetic peptide
  Seed: CEPPEVGSDCT (TP53 Y220C)
CEPPEVGSDCV

SEQ ID NO: 21971 - protein, 10 aa, Artificial Sequence
  Description of Artificial Sequence: Synthetic peptide
  Seed: CEPPEVGSDC (TP53 Y220C)
CEPPEVGSDF

SEQ ID NO: 21972 - protein, 10 aa, Artificial Sequence
  Description of Artificial Sequence: Synthetic peptide
  Seed: CEPPEVGSDC (TP53 Y220C)
CEPPEVGSDI

SEQ ID NO: 21973 - protein, 10 aa, Artificial Sequence
  Description of Artificial Sequence: Synthetic peptide
  Seed: CEPPEVGSDC (TP53 Y220C)
CEPPEVGSDL

SEQ ID NO: 21974 - protein, 10 aa, Artificial Sequence
  Description of Artificial Sequence: Synthetic peptide
  Seed: CEPPEVGSDC (TP53 Y220C)
CEPPEVGSDM

SEQ ID NO: 21975 - protein, 10 aa, Artificial Sequence
  Description of Artificial Sequence: Synthetic peptide
  Seed: CEPPEVGSDC (TP53 Y220C)
CEPPEVGSDP

SEQ ID NO: 21976 - protein, 10 aa, Artificial Sequence
  Description of Artificial Sequence: Synthetic peptide
  Seed: CEPPEVGSDC (TP53 Y220C)
CEPPEVGSDS

SEQ ID NO: 21977 - protein, 10 aa, Artificial Sequence
  Description of Artificial Sequence: Synthetic peptide
  Seed: CEPPEVGSDC (TP53 Y220C)
CEPPEVGSDT

SEQ ID NO: 21978 - protein, 10 aa, Artificial Sequence
  Description of Artificial Sequence: Synthetic peptide
  Seed: CEPPEVGSDC (TP53 Y220C)
CEPPEVGSDV

SEQ ID NO: 21979 - protein, 8 aa, Artificial Sequence
  Description of Artificial Sequence: Synthetic peptide
  Seed: VPCEPPEV (TP53 Y220C)
VACEPPEA

SEQ ID NO: 21980 - protein, 8 aa, Artificial Sequence
  Description of Artificial Sequence: Synthetic peptide
  Seed: VPCEPPEV (TP53 Y220C)
VACEPPEF

SEQ ID NO: 21981 - protein, 8 aa, Artificial Sequence
  Description of Artificial Sequence: Synthetic peptide
  Seed: VPCEPPEV (TP53 Y220C)
VACEPPEI

SEQ ID NO: 21982 - protein, 8 aa, Artificial Sequence
  Description of Artificial Sequence: Synthetic peptide
  Seed: VPCEPPEV (TP53 Y220C)
VACEPPEL

SEQ ID NO: 21983 - protein, 8 aa, Artificial Sequence
  Description of Artificial Sequence: Synthetic peptide
  Seed: VPCEPPEV (TP53 Y220C)
VACEPPEM

SEQ ID NO: 21984 - protein, 8 aa, Artificial Sequence
  Description of Artificial Sequence: Synthetic peptide
  Seed: VPCEPPEV (TP53 Y220C)
VACEPPEV

SEQ ID NO: 21985 - protein, 9 aa, Artificial Sequence
  Description of Artificial Sequence: Synthetic peptide
  Seed: VPCEPPEVG (TP53 Y220C)
VACEPPEVA

SEQ ID NO: 21986 - protein, 9 aa, Artificial Sequence
  Description of Artificial Sequence: Synthetic peptide
  Seed: VPCEPPEVG (TP53 Y220C)
VACEPPEVC

SEQ ID NO: 21987 - protein, 9 aa, Artificial Sequence
  Description of Artificial Sequence: Synthetic peptide
  Seed: VPCEPPEVG (TP53 Y220C)
VACEPPEVF

SEQ ID NO: 21988 - protein, 10 aa, Artificial Sequence
  Description of Artificial Sequence: Synthetic peptide
  Seed: VPCEPPEVGS (TP53 Y220C)
VACEPPEVGA

SEQ ID NO: 21989 - protein, 10 aa, Artificial Sequence
  Description of Artificial Sequence: Synthetic peptide
  Seed: VPCEPPEVGS (TP53 Y220C)
VACEPPEVGL

SEQ ID NO: 21990 - protein, 10 aa, Artificial Sequence
  Description of Artificial Sequence: Synthetic peptide
  Seed: VPCEPPEVGS (TP53 Y220C)
VACEPPEVGM

SEQ ID NO: 21991 - protein, 9 aa, Artificial Sequence
  Description of Artificial Sequence: Synthetic peptide
  Seed: VPCEPPEVG (TP53 Y220C)
VACEPPEVH

SEQ ID NO: 21992 - protein, 9 aa, Artificial Sequence
  Description of Artificial Sequence: Synthetic peptide
  Seed: VPCEPPEVG (TP53 Y220C)
VACEPPEVI

SEQ ID NO: 21993 - protein, 9 aa, Artificial Sequence
  Description of Artificial Sequence: Synthetic peptide
  Seed: VPCEPPEVG (TP53 Y220C)
VACEPPEVL

SEQ ID NO: 21994 - protein, 9 aa, Artificial Sequence
  Description of Artificial Sequence: Synthetic peptide
  Seed: VPCEPPEVG (TP53 Y220C)
VACEPPEVM

SEQ ID NO: 21995 - protein, 9 aa, Artificial Sequence
  Description of Artificial Sequence: Synthetic peptide
  Seed: VPCEPPEVG (TP53 Y220C)
VACEPPEVP

SEQ ID NO: 21996 - protein, 9 aa, Artificial Sequence
  Description of Artificial Sequence: Synthetic peptide
  Seed: VPCEPPEVG (TP53 Y220C)
VACEPPEVT

SEQ ID NO: 21997 - protein, 9 aa, Artificial Sequence
  Description of Artificial Sequence: Synthetic peptide
  Seed: VPCEPPEVG (TP53 Y220C)
VACEPPEVV

SEQ ID NO: 21998 - protein, 9 aa, Artificial Sequence
  Description of Artificial Sequence: Synthetic peptide
  Seed: VPCEPPEVG (TP53 Y220C)
VACEPPEVW

SEQ ID NO: 21999 - protein, 9 aa, Artificial Sequence
  Description of Artificial Sequence: Synthetic peptide
  Seed: VPCEPPEVG (TP53 Y220C)
VACEPPEVY

SEQ ID NO: 22000 - protein, 8 aa, Artificial Sequence
  Description of Artificial Sequence: Synthetic peptide
  Seed: VPCEPPEV (TP53 Y220C)
VACEPPEY

SEQ ID NO: 22001 - protein, 9 aa, Artificial Sequence
  Description of Artificial Sequence: Synthetic peptide
  Seed: VVPCEPPEV (TP53 Y220C)
VAPCEPPEA

SEQ ID NO: 22002 - protein, 9 aa, Artificial Sequence
  Description of Artificial Sequence: Synthetic peptide
  Seed: VVPCEPPEV (TP53 Y220C)
VAPCEPPEC

SEQ ID NO: 22003 - protein, 9 aa, Artificial Sequence
  Description of Artificial Sequence: Synthetic peptide
  Seed: VVPCEPPEV (TP53 Y220C)
VAPCEPPEF

SEQ ID NO: 22004 - protein, 9 aa, Artificial Sequence
  Description of Artificial Sequence: Synthetic peptide
  Seed: VVPCEPPEV (TP53 Y220C)
VAPCEPPEH

SEQ ID NO: 22005 - protein, 9 aa, Artificial Sequence
  Description of Artificial Sequence: Synthetic peptide
  Seed: VVPCEPPEV (TP53 Y220C)
VAPCEPPEI

SEQ ID NO: 22006 - protein, 9 aa, Artificial Sequence
  Description of Artificial Sequence: Synthetic peptide
  Seed: VVPCEPPEV (TP53 Y220C)
VAPCEPPEK

SEQ ID NO: 22007 - protein, 9 aa, Artificial Sequence
  Description of Artificial Sequence: Synthetic peptide
  Seed: VVPCEPPEV (TP53 Y220C)
VAPCEPPER

SEQ ID NO: 22008 - protein, 9 aa, Artificial Sequence
  Description of Artificial Sequence: Synthetic peptide
  Seed: VVPCEPPEV (TP53 Y220C)
VAPCEPPET

SEQ ID NO: 22009 - protein, 9 aa, Artificial Sequence
  Description of Artificial Sequence: Synthetic peptide
  Seed: VVPCEPPEV (TP53 Y220C)
VAPCEPPEV

SEQ ID NO: 22010 - protein, 9 aa, Artificial Sequence
  Description of Artificial Sequence: Synthetic peptide
  Seed: VVPCEPPEV (TP53 Y220C)
VAPCEPPEW

SEQ ID NO: 22011 - protein, 9 aa, Artificial Sequence
  Description of Artificial Sequence: Synthetic peptide
  Seed: VVPCEPPEV (TP53 Y220C)
VAPCEPPEY

SEQ ID NO: 22012 - protein, 10 aa, Artificial Sequence
  Description of Artificial Sequence: Synthetic peptide
  Seed: VVVPCEPPEV (TP53 Y220C)
VAVPCEPPEF

SEQ ID NO: 22013 - protein, 10 aa, Artificial Sequence
  Description of Artificial Sequence: Synthetic peptide
  Seed: VVVPCEPPEV (TP53 Y220C)
VAVPCEPPEI

SEQ ID NO: 22014 - protein, 10 aa, Artificial Sequence
  Description of Artificial Sequence: Synthetic peptide
  Seed: VVVPCEPPEV (TP53 Y220C)
VAVPCEPPEL

SEQ ID NO: 22015 - protein, 10 aa, Artificial Sequence
  Description of Artificial Sequence: Synthetic peptide
  Seed: VVVPCEPPEV (TP53 Y220C)
VAVPCEPPEM

SEQ ID NO: 22016 - protein, 10 aa, Artificial Sequence
  Description of Artificial Sequence: Synthetic peptide
  Seed: VVVPCEPPEV (TP53 Y220C)
VAVPCEPPEV

SEQ ID NO: 22017 - protein, 8 aa, Artificial Sequence
  Description of Artificial Sequence: Synthetic peptide
  Seed: VPCEPPEV (TP53 Y220C)
VCCEPPEL

SEQ ID NO: 22018 - protein, 9 aa, Artificial Sequence
  Description of Artificial Sequence: Synthetic peptide
  Seed: VPCEPPEVG (TP53 Y220C)
VCCEPPEVF

SEQ ID NO: 22019 - protein, 9 aa, Artificial Sequence
  Description of Artificial Sequence: Synthetic peptide
  Seed: VPCEPPEVG (TP53 Y220C)
VCCEPPEVI

SEQ ID NO: 22020 - protein, 9 aa, Artificial Sequence
  Description of Artificial Sequence: Synthetic peptide
  Seed: VPCEPPEVG (TP53 Y220C)
VCCEPPEVM

SEQ ID NO: 22021 - protein, 9 aa, Artificial Sequence
  Description of Artificial Sequence: Synthetic peptide
  Seed: VPCEPPEVG (TP53 Y220C)
VCCEPPEVV

SEQ ID NO: 22022 - protein, 9 aa, Artificial Sequence
  Description of Artificial Sequence: Synthetic peptide
  Seed: VPCEPPEVG (TP53 Y220C)
VCCEPPEVY

SEQ ID NO: 22023 - protein, 9 aa, Artificial Sequence
  Description of Artificial Sequence: Synthetic peptide
  Seed: VVPCEPPEV (TP53 Y220C)
VCPCEPPEF

SEQ ID NO: 22024 - protein, 9 aa, Artificial Sequence
  Description of Artificial Sequence: Synthetic peptide
  Seed: VVPCEPPEV (TP53 Y220C)
VCPCEPPEI

SEQ ID NO: 22025 - protein, 9 aa, Artificial Sequence
  Description of Artificial Sequence: Synthetic peptide
  Seed: VVPCEPPEV (TP53 Y220C)
VCPCEPPEL

SEQ ID NO: 22026 - protein, 9 aa, Artificial Sequence
  Description of Artificial Sequence: Synthetic peptide
  Seed: VVPCEPPEV (TP53 Y220C)
VCPCEPPEM

SEQ ID NO: 22027 - protein, 9 aa, Artificial Sequence
  Description of Artificial Sequence: Synthetic peptide
  Seed: VVPCEPPEV (TP53 Y220C)
VCPCEPPEV

SEQ ID NO: 22028 - protein, 9 aa, Artificial Sequence
  Description of Artificial Sequence: Synthetic peptide
  Seed: VVPCEPPEV (TP53 Y220C)
VCPCEPPEY

SEQ ID NO: 22029 - protein, 10 aa, Artificial Sequence
  Description of Artificial Sequence: Synthetic peptide
  Seed: VVVPCEPPEV (TP53 Y220C)
VCVPCEPPEL

SEQ ID NO: 22030 - protein, 8 aa, Artificial Sequence
  Description of Artificial Sequence: Synthetic peptide
  Seed: VPCEPPEV (TP53 Y220C)
VDCEPPEI

SEQ ID NO: 22031 - protein, 8 aa, Artificial Sequence
  Description of Artificial Sequence: Synthetic peptide
  Seed: VPCEPPEV (TP53 Y220C)
VDCEPPEL

SEQ ID NO: 22032 - protein, 8 aa, Artificial Sequence
  Description of Artificial Sequence: Synthetic peptide
  Seed: VPCEPPEV (TP53 Y220C)
VDCEPPEV

SEQ ID NO: 22033 - protein, 9 aa, Artificial Sequence
  Description of Artificial Sequence: Synthetic peptide
  Seed: VPCEPPEVG (TP53 Y220C)
VDCEPPEVF

SEQ ID NO: 22034 - protein, 9 aa, Artificial Sequence
  Description of Artificial Sequence: Synthetic peptide
  Seed: VPCEPPEVG (TP53 Y220C)
VDCEPPEVY

SEQ ID NO: 22035 - protein, 9 aa, Artificial Sequence
  Description of Artificial Sequence: Synthetic peptide
  Seed: VVPCEPPEV (TP53 Y220C)
VDPCEPPEF

SEQ ID NO: 22036 - protein, 9 aa, Artificial Sequence
  Description of Artificial Sequence: Synthetic peptide
  Seed: VVPCEPPEV (TP53 Y220C)
VDPCEPPEK

SEQ ID NO: 22037 - protein, 9 aa, Artificial Sequence
  Description of Artificial Sequence: Synthetic peptide
  Seed: VVPCEPPEV (TP53 Y220C)
VDPCEPPEL

SEQ ID NO: 22038 - protein, 9 aa, Artificial Sequence
  Description of Artificial Sequence: Synthetic peptide
  Seed: VVPCEPPEV (TP53 Y220C)
VDPCEPPEM

SEQ ID NO: 22039 - protein, 9 aa, Artificial Sequence
  Description of Artificial Sequence: Synthetic peptide
  Seed: VVPCEPPEV (TP53 Y220C)
VDPCEPPER

SEQ ID NO: 22040 - protein, 9 aa, Artificial Sequence
  Description of Artificial Sequence: Synthetic peptide
  Seed: VVPCEPPEV (TP53 Y220C)
VDPCEPPEV

SEQ ID NO: 22041 - protein, 8 aa, Artificial Sequence
  Description of Artificial Sequence: Synthetic peptide
  Seed: VPCEPPEV (TP53 Y220C)
VECEPPEI

SEQ ID NO: 22042 - protein, 8 aa, Artificial Sequence
  Description of Artificial Sequence: Synthetic peptide
  Seed: VPCEPPEV (TP53 Y220C)
VECEPPEL

SEQ ID NO: 22043 - protein, 8 aa, Artificial Sequence
  Description of Artificial Sequence: Synthetic peptide
  Seed: VPCEPPEV (TP53 Y220C)
VECEPPEV

SEQ ID NO: 22044 - protein, 9 aa, Artificial Sequence
  Description of Artificial Sequence: Synthetic peptide
  Seed: VPCEPPEVG (TP53 Y220C)
VECEPPEVY

SEQ ID NO: 22045 - protein, 9 aa, Artificial Sequence
  Description of Artificial Sequence: Synthetic peptide
  Seed: VVPCEPPEV (TP53 Y220C)
VEPCEPPEF

SEQ ID NO: 22046 - protein, 9 aa, Artificial Sequence
  Description of Artificial Sequence: Synthetic peptide
  Seed: VVPCEPPEV (TP53 Y220C)
VEPCEPPEI

SEQ ID NO: 22047 - protein, 9 aa, Artificial Sequence
  Description of Artificial Sequence: Synthetic peptide
  Seed: VVPCEPPEV (TP53 Y220C)
VEPCEPPEK

SEQ ID NO: 22048 - protein, 9 aa, Artificial Sequence
  Description of Artificial Sequence: Synthetic peptide
  Seed: VVPCEPPEV (TP53 Y220C)
VEPCEPPEL

SEQ ID NO: 22049 - protein, 9 aa, Artificial Sequence
  Description of Artificial Sequence: Synthetic peptide
  Seed: VVPCEPPEV (TP53 Y220C)
VEPCEPPEM

SEQ ID NO: 22050 - protein, 9 aa, Artificial Sequence
  Description of Artificial Sequence: Synthetic peptide
  Seed: VVPCEPPEV (TP53 Y220C)
VEPCEPPER

SEQ ID NO: 22051 - protein, 9 aa, Artificial Sequence
  Description of Artificial Sequence: Synthetic peptide
  Seed: VVPCEPPEV (TP53 Y220C)
VEPCEPPEV

SEQ ID NO: 22052 - protein, 9 aa, Artificial Sequence
  Description of Artificial Sequence: Synthetic peptide
  Seed: VVPCEPPEV (TP53 Y220C)
VEPCEPPEY

SEQ ID NO: 22053 - protein, 10 aa, Artificial Sequence
  Description of Artificial Sequence: Synthetic peptide
  Seed: VVVPCEPPEV (TP53 Y220C)
VEVPCEPPEI

SEQ ID NO: 22054 - protein, 10 aa, Artificial Sequence
  Description of Artificial Sequence: Synthetic peptide
  Seed: VVVPCEPPEV (TP53 Y220C)
VEVPCEPPEL

SEQ ID NO: 22055 - protein, 10 aa, Artificial Sequence
  Description of Artificial Sequence: Synthetic peptide
  Seed: VVVPCEPPEV (TP53 Y220C)
VEVPCEPPEV

SEQ ID NO: 22056 - protein, 8 aa, Artificial Sequence
  Description of Artificial Sequence: Synthetic peptide
  Seed: VPCEPPEV (TP53 Y220C)
VFCEPPEI

SEQ ID NO: 22057 - protein, 8 aa, Artificial Sequence
  Description of Artificial Sequence: Synthetic peptide
  Seed: VPCEPPEV (TP53 Y220C)
VFCEPPEL

SEQ ID NO: 22058 - protein, 8 aa, Artificial Sequence
  Description of Artificial Sequence: Synthetic peptide
  Seed: VPCEPPEV (TP53 Y220C)
VFCEPPEM

SEQ ID NO: 22059 - protein, 8 aa, Artificial Sequence
  Description of Artificial Sequence: Synthetic peptide
  Seed: VPCEPPEV (TP53 Y220C)
VFCEPPEV

SEQ ID NO: 22060 - protein, 9 aa, Artificial Sequence
  Description of Artificial Sequence: Synthetic peptide
  Seed: VPCEPPEVG (TP53 Y220C)
VFCEPPEVF

SEQ ID NO: 22061 - protein, 9 aa, Artificial Sequence
  Description of Artificial Sequence: Synthetic peptide
  Seed: VPCEPPEVG (TP53 Y220C)
VFCEPPEVY

SEQ ID NO: 22062 - protein, 9 aa, Artificial Sequence
  Description of Artificial Sequence: Synthetic peptide
  Seed: VVPCEPPEV (TP53 Y220C)
VFPCEPPEA

SEQ ID NO: 22063 - protein, 9 aa, Artificial Sequence
  Description of Artificial Sequence: Synthetic peptide
  Seed: VVPCEPPEV (TP53 Y220C)
VFPCEPPEC

SEQ ID NO: 22064 - protein, 9 aa, Artificial Sequence
  Description of Artificial Sequence: Synthetic peptide
  Seed: VVPCEPPEV (TP53 Y220C)
VFPCEPPEF

SEQ ID NO: 22065 - protein, 9 aa, Artificial Sequence
  Description of Artificial Sequence: Synthetic peptide
  Seed: VVPCEPPEV (TP53 Y220C)
VFPCEPPEI

SEQ ID NO: 22066 - protein, 9 aa, Artificial Sequence
  Description of Artificial Sequence: Synthetic peptide
  Seed: VVPCEPPEV (TP53 Y220C)
VFPCEPPEK

SEQ ID NO: 22067 - protein, 9 aa, Artificial Sequence
  Description of Artificial Sequence: Synthetic peptide
  Seed: VVPCEPPEV (TP53 Y220C)
VFPCEPPEL

SEQ ID NO: 22068 - protein, 9 aa, Artificial Sequence
  Description of Artificial Sequence: Synthetic peptide
  Seed: VVPCEPPEV (TP53 Y220C)
VFPCEPPER

SEQ ID NO: 22069 - protein, 9 aa, Artificial Sequence
  Description of Artificial Sequence: Synthetic peptide
  Seed: VVPCEPPEV (TP53 Y220C)
VFPCEPPEV

SEQ ID NO: 22070 - protein, 9 aa, Artificial Sequence
  Description of Artificial Sequence: Synthetic peptide
  Seed: VVPCEPPEV (TP53 Y220C)
VFPCEPPEY

SEQ ID NO: 22071 - protein, 8 aa, Artificial Sequence
  Description of Artificial Sequence: Synthetic peptide
  Seed: VPCEPPEV (TP53 Y220C)
VGCEPPEI

SEQ ID NO: 22072 - protein, 8 aa, Artificial Sequence
  Description of Artificial Sequence: Synthetic peptide
  Seed: VPCEPPEV (TP53 Y220C)
VGCEPPEL

SEQ ID NO: 22073 - protein, 8 aa, Artificial Sequence
  Description of Artificial Sequence: Synthetic peptide
  Seed: VPCEPPEV (TP53 Y220C)
VGCEPPEM

SEQ ID NO: 22074 - protein, 8 aa, Artificial Sequence
  Description of Artificial Sequence: Synthetic peptide
  Seed: VPCEPPEV (TP53 Y220C)
VGCEPPEV

SEQ ID NO: 22075 - protein, 9 aa, Artificial Sequence
  Description of Artificial Sequence: Synthetic peptide
  Seed: VPCEPPEVG (TP53 Y220C)
VGCEPPEVA

SEQ ID NO: 22076 - protein, 9 aa, Artificial Sequence
  Description of Artificial Sequence: Synthetic peptide
  Seed: VPCEPPEVG (TP53 Y220C)
VGCEPPEVF

SEQ ID NO: 22077 - protein, 9 aa, Artificial Sequence
  Description of Artificial Sequence: Synthetic peptide
  Seed: VPCEPPEVG (TP53 Y220C)
VGCEPPEVI

SEQ ID NO: 22078 - protein, 9 aa, Artificial Sequence
  Description of Artificial Sequence: Synthetic peptide
  Seed: VPCEPPEVG (TP53 Y220C)
VGCEPPEVL

SEQ ID NO: 22079 - protein, 9 aa, Artificial Sequence
  Description of Artificial Sequence: Synthetic peptide
  Seed: VPCEPPEVG (TP53 Y220C)
VGCEPPEVM

SEQ ID NO: 22080 - protein, 9 aa, Artificial Sequence
  Description of Artificial Sequence: Synthetic peptide
  Seed: VPCEPPEVG (TP53 Y220C)
VGCEPPEVV

SEQ ID NO: 22081 - protein, 9 aa, Artificial Sequence
  Description of Artificial Sequence: Synthetic peptide
  Seed: VPCEPPEVG (TP53 Y220C)
VGCEPPEVY

SEQ ID NO: 22082 - protein, 9 aa, Artificial Sequence
  Description of Artificial Sequence: Synthetic peptide
  Seed: VVPCEPPEV (TP53 Y220C)
VGPCEPPEF

SEQ ID NO: 22083 - protein, 9 aa, Artificial Sequence
  Description of Artificial Sequence: Synthetic peptide
  Seed: VVPCEPPEV (TP53 Y220C)
VGPCEPPEI

SEQ ID NO: 22084 - protein, 9 aa, Artificial Sequence
  Description of Artificial Sequence: Synthetic peptide
  Seed: VVPCEPPEV (TP53 Y220C)
VGPCEPPEK

SEQ ID NO: 22085 - protein, 9 aa, Artificial Sequence
  Description of Artificial Sequence: Synthetic peptide
  Seed: VVPCEPPEV (TP53 Y220C)
VGPCEPPEL

SEQ ID NO: 22086 - protein, 9 aa, Artificial Sequence
  Description of Artificial Sequence: Synthetic peptide
  Seed: VVPCEPPEV (TP53 Y220C)
VGPCEPPEM

SEQ ID NO: 22087 - protein, 9 aa, Artificial Sequence
  Description of Artificial Sequence: Synthetic peptide
  Seed: VVPCEPPEV (TP53 Y220C)
VGPCEPPER

SEQ ID NO: 22088 - protein, 9 aa, Artificial Sequence
  Description of Artificial Sequence: Synthetic peptide
  Seed: VVPCEPPEV (TP53 Y220C)
VGPCEPPEV

SEQ ID NO: 22089 - protein, 9 aa, Artificial Sequence
  Description of Artificial Sequence: Synthetic peptide
  Seed: VVPCEPPEV (TP53 Y220C)
VGPCEPPEY

SEQ ID NO: 22090 - protein, 10 aa, Artificial Sequence
  Description of Artificial Sequence: Synthetic peptide
  Seed: VVVPCEPPEV (TP53 Y220C)
VGVPCEPPEL

SEQ ID NO: 22091 - protein, 10 aa, Artificial Sequence
  Description of Artificial Sequence: Synthetic peptide
  Seed: VVVPCEPPEV (TP53 Y220C)
VGVPCEPPEM

SEQ ID NO: 22092 - protein, 8 aa, Artificial Sequence
  Description of Artificial Sequence: Synthetic peptide
  Seed: VPCEPPEV (TP53 Y220C)
VHCEPPEI

SEQ ID NO: 22093 - protein, 8 aa, Artificial Sequence
  Description of Artificial Sequence: Synthetic peptide
  Seed: VPCEPPEV (TP53 Y220C)
VHCEPPEV

SEQ ID NO: 22094 - protein, 9 aa, Artificial Sequence
  Description of Artificial Sequence: Synthetic peptide
  Seed: VVPCEPPEV (TP53 Y220C)
VHPCEPPEF

SEQ ID NO: 22095 - protein, 9 aa, Artificial Sequence
  Description of Artificial Sequence: Synthetic peptide
  Seed: VVPCEPPEV (TP53 Y220C)
VHPCEPPEI

SEQ ID NO: 22096 - protein, 9 aa, Artificial Sequence
  Description of Artificial Sequence: Synthetic peptide
  Seed: VVPCEPPEV (TP53 Y220C)
VHPCEPPEL

SEQ ID NO: 22097 - protein, 9 aa, Artificial Sequence
  Description of Artificial Sequence: Synthetic peptide
  Seed: VVPCEPPEV (TP53 Y220C)
VHPCEPPEM

SEQ ID NO: 22098 - protein, 9 aa, Artificial Sequence
  Description of Artificial Sequence: Synthetic peptide
  Seed: VVPCEPPEV (TP53 Y220C)
VHPCEPPEV

SEQ ID NO: 22099 - protein, 8 aa, Artificial Sequence
  Description of Artificial Sequence: Synthetic peptide
  Seed: VPCEPPEV (TP53 Y220C)
VICEPPEF

SEQ ID NO: 22100 - protein, 8 aa, Artificial Sequence
  Description of Artificial Sequence: Synthetic peptide
  Seed: VPCEPPEV (TP53 Y220C)
VICEPPEI

SEQ ID NO: 22101 - protein, 8 aa, Artificial Sequence
  Description of Artificial Sequence: Synthetic peptide
  Seed: VPCEPPEV (TP53 Y220C)
VICEPPEL

SEQ ID NO: 22102 - protein, 8 aa, Artificial Sequence
  Description of Artificial Sequence: Synthetic peptide
  Seed: VPCEPPEV (TP53 Y220C)
VICEPPEM

SEQ ID NO: 22103 - protein, 8 aa, Artificial Sequence
  Description of Artificial Sequence: Synthetic peptide
  Seed: VPCEPPEV (TP53 Y220C)
VICEPPEV

SEQ ID NO: 22104 - protein, 9 aa, Artificial Sequence
  Description of Artificial Sequence: Synthetic peptide
  Seed: VPCEPPEVG (TP53 Y220C)
VICEPPEVA

SEQ ID NO: 22105 - protein, 9 aa, Artificial Sequence
  Description of Artificial Sequence: Synthetic peptide
  Seed: VPCEPPEVG (TP53 Y220C)
VICEPPEVF

SEQ ID NO: 22106 - protein, 9 aa, Artificial Sequence
  Description of Artificial Sequence: Synthetic peptide
  Seed: VPCEPPEVG (TP53 Y220C)
VICEPPEVI

SEQ ID NO: 22107 - protein, 9 aa, Artificial Sequence
  Description of Artificial Sequence: Synthetic peptide
  Seed: VPCEPPEVG (TP53 Y220C)
VICEPPEVL

SEQ ID NO: 22108 - protein, 9 aa, Artificial Sequence
  Description of Artificial Sequence: Synthetic peptide
  Seed: VPCEPPEVG (TP53 Y220C)
VICEPPEVM

SEQ ID NO: 22109 - protein, 9 aa, Artificial Sequence
  Description of Artificial Sequence: Synthetic peptide
  Seed: VPCEPPEVG (TP53 Y220C)
VICEPPEVV

SEQ ID NO: 22110 - protein, 9 aa, Artificial Sequence
  Description of Artificial Sequence: Synthetic peptide
  Seed: VPCEPPEVG (TP53 Y220C)
VICEPPEVY

SEQ ID NO: 22111 - protein, 9 aa, Artificial Sequence
  Description of Artificial Sequence: Synthetic peptide
  Seed: VVPCEPPEV (TP53 Y220C)
VIPCEPPEA

SEQ ID NO: 22112 - protein, 9 aa, Artificial Sequence
  Description of Artificial Sequence: Synthetic peptide
  Seed: VVPCEPPEV (TP53 Y220C)
VIPCEPPEC

SEQ ID NO: 22113 - protein, 9 aa, Artificial Sequence
  Description of Artificial Sequence: Synthetic peptide
  Seed: VVPCEPPEV (TP53 Y220C)
VIPCEPPEF

SEQ ID NO: 22114 - protein, 9 aa, Artificial Sequence
  Description of Artificial Sequence: Synthetic peptide
  Seed: VVPCEPPEV (TP53 Y220C)
VIPCEPPEH

SEQ ID NO: 22115 - protein, 9 aa, Artificial Sequence
  Description of Artificial Sequence: Synthetic peptide
  Seed: VVPCEPPEV (TP53 Y220C)
VIPCEPPEK

SEQ ID NO: 22116 - protein, 9 aa, Artificial Sequence
  Description of Artificial Sequence: Synthetic peptide
  Seed: VVPCEPPEV (TP53 Y220C)
VIPCEPPEM

SEQ ID NO: 22117 - protein, 9 aa, Artificial Sequence
  Description of Artificial Sequence: Synthetic peptide
  Seed: VVPCEPPEV (TP53 Y220C)
VIPCEPPER

SEQ ID NO: 22118 - protein, 9 aa, Artificial Sequence
  Description of Artificial Sequence: Synthetic peptide
  Seed: VVPCEPPEV (TP53 Y220C)
VIPCEPPEW

SEQ ID NO: 22119 - protein, 9 aa, Artificial Sequence
  Description of Artificial Sequence: Synthetic peptide
  Seed: VVPCEPPEV (TP53 Y220C)
VIPCEPPEY

SEQ ID NO: 22120 - protein, 10 aa, Artificial Sequence
  Description of Artificial Sequence: Synthetic peptide
  Seed: VVVPCEPPEV (TP53 Y220C)
VIVPCEPPEA

SEQ ID NO: 22121 - protein, 10 aa, Artificial Sequence
  Description of Artificial Sequence: Synthetic peptide
  Seed: VVVPCEPPEV (TP53 Y220C)
VIVPCEPPEF

SEQ ID NO: 22122 - protein, 10 aa, Artificial Sequence
  Description of Artificial Sequence: Synthetic peptide
  Seed: VVVPCEPPEV (TP53 Y220C)
VIVPCEPPEI

SEQ ID NO: 22123 - protein, 10 aa, Artificial Sequence
  Description of Artificial Sequence: Synthetic peptide
  Seed: VVVPCEPPEV (TP53 Y220C)
VIVPCEPPEL

SEQ ID NO: 22124 - protein, 10 aa, Artificial Sequence
  Description of Artificial Sequence: Synthetic peptide
  Seed: VVVPCEPPEV (TP53 Y220C)
VIVPCEPPEM

SEQ ID NO: 22125 - protein, 8 aa, Artificial Sequence
  Description of Artificial Sequence: Synthetic peptide
  Seed: VPCEPPEV (TP53 Y220C)
VKCEPPEI

SEQ ID NO: 22126 - protein, 8 aa, Artificial Sequence
  Description of Artificial Sequence: Synthetic peptide
  Seed: VPCEPPEV (TP53 Y220C)
VKCEPPEV

SEQ ID NO: 22127 - protein, 9 aa, Artificial Sequence
  Description of Artificial Sequence: Synthetic peptide
  Seed: VVPCEPPEV (TP53 Y220C)
VKPCEPPEF

SEQ ID NO: 22128 - protein, 9 aa, Artificial Sequence
  Description of Artificial Sequence: Synthetic peptide
  Seed: VVPCEPPEV (TP53 Y220C)
VKPCEPPEI

SEQ ID NO: 22129 - protein, 9 aa, Artificial Sequence
  Description of Artificial Sequence: Synthetic peptide
  Seed: VVPCEPPEV (TP53 Y220C)
VKPCEPPEL

SEQ ID NO: 22130 - protein, 9 aa, Artificial Sequence
  Description of Artificial Sequence: Synthetic peptide
  Seed: VVPCEPPEV (TP53 Y220C)
VKPCEPPEM

SEQ ID NO: 22131 - protein, 8 aa, Artificial Sequence
  Description of Artificial Sequence: Synthetic peptide
  Seed: VPCEPPEV (TP53 Y220C)
VLCEPPEI

SEQ ID NO: 22132 - protein, 8 aa, Artificial Sequence
  Description of Artificial Sequence: Synthetic peptide
  Seed: VPCEPPEV (TP53 Y220C)
VLCEPPEL

SEQ ID NO: 22133 - protein, 8 aa, Artificial Sequence
  Description of Artificial Sequence: Synthetic peptide
  Seed: VPCEPPEV (TP53 Y220C)
VLCEPPEM

SEQ ID NO: 22134 - protein, 8 aa, Artificial Sequence
  Description of Artificial Sequence: Synthetic peptide
  Seed: VPCEPPEV (TP53 Y220C)
VLCEPPEV

SEQ ID NO: 22135 - protein, 9 aa, Artificial Sequence
  Description of Artificial Sequence: Synthetic peptide
  Seed: VPCEPPEVG (TP53 Y220C)
VLCEPPEVA

SEQ ID NO: 22136 - protein, 9 aa, Artificial Sequence
  Description of Artificial Sequence: Synthetic peptide
  Seed: VPCEPPEVG (TP53 Y220C)
VLCEPPEVF

SEQ ID NO: 22137 - protein, 9 aa, Artificial Sequence
  Description of Artificial Sequence: Synthetic peptide
  Seed: VPCEPPEVG (TP53 Y220C)
VLCEPPEVL

SEQ ID NO: 22138 - protein, 9 aa, Artificial Sequence
  Description of Artificial Sequence: Synthetic peptide
  Seed: VPCEPPEVG (TP53 Y220C)
VLCEPPEVM

SEQ ID NO: 22139 - protein, 9 aa, Artificial Sequence
  Description of Artificial Sequence: Synthetic peptide
  Seed: VPCEPPEVG (TP53 Y220C)
VLCEPPEVY

SEQ ID NO: 22140 - protein, 9 aa, Artificial Sequence
  Description of Artificial Sequence: Synthetic peptide
  Seed: VVPCEPPEV (TP53 Y220C)
VLPCEPPEF

SEQ ID NO: 22141 - protein, 9 aa, Artificial Sequence
  Description of Artificial Sequence: Synthetic peptide
  Seed: VVPCEPPEV (TP53 Y220C)
VLPCEPPEH

SEQ ID NO: 22142 - protein, 9 aa, Artificial Sequence
  Description of Artificial Sequence: Synthetic peptide
  Seed: VVPCEPPEV (TP53 Y220C)
VLPCEPPEK

SEQ ID NO: 22143 - protein, 9 aa, Artificial Sequence
  Description of Artificial Sequence: Synthetic peptide
  Seed: VVPCEPPEV (TP53 Y220C)
VLPCEPPER

SEQ ID NO: 22144 - protein, 9 aa, Artificial Sequence
  Description of Artificial Sequence: Synthetic peptide
  Seed: VVPCEPPEV (TP53 Y220C)
VLPCEPPET

SEQ ID NO: 22145 - protein, 9 aa, Artificial Sequence
  Description of Artificial Sequence: Synthetic peptide
  Seed: VVPCEPPEV (TP53 Y220C)
VLPCEPPEW

SEQ ID NO: 22146 - protein, 9 aa, Artificial Sequence
  Description of Artificial Sequence: Synthetic peptide
  Seed: VVPCEPPEV (TP53 Y220C)
VLPCEPPEY

SEQ ID NO: 22147 - protein, 10 aa, Artificial Sequence
  Description of Artificial Sequence: Synthetic peptide
  Seed: VVVPCEPPEV (TP53 Y220C)
VLVPCEPPEA

SEQ ID NO: 22148 - protein, 10 aa, Artificial Sequence
  Description of Artificial Sequence: Synthetic peptide
  Seed: VVVPCEPPEV (TP53 Y220C)
VLVPCEPPEC

SEQ ID NO: 22149 - protein, 10 aa, Artificial Sequence
  Description of Artificial Sequence: Synthetic peptide
  Seed: VVVPCEPPEV (TP53 Y220C)
VLVPCEPPEF

SEQ ID NO: 22150 - protein, 10 aa, Artificial Sequence
  Description of Artificial Sequence: Synthetic peptide
  Seed: VVVPCEPPEV (TP53 Y220C)
VLVPCEPPEL

SEQ ID NO: 22151 - protein, 10 aa, Artificial Sequence
  Description of Artificial Sequence: Synthetic peptide
  Seed: VVVPCEPPEV (TP53 Y220C)
VLVPCEPPEM

SEQ ID NO: 22152 - protein, 10 aa, Artificial Sequence
  Description of Artificial Sequence: Synthetic peptide
  Seed: VVVPCEPPEV (TP53 Y220C)
VLVPCEPPET

SEQ ID NO: 22153 - protein, 8 aa, Artificial Sequence
  Description of Artificial Sequence: Synthetic peptide
  Seed: VPCEPPEV (TP53 Y220C)
VMCEPPEI

SEQ ID NO: 22154 - protein, 8 aa, Artificial Sequence
  Description of Artificial Sequence: Synthetic peptide
  Seed: VPCEPPEV (TP53 Y220C)
VMCEPPEL

SEQ ID NO: 22155 - protein, 8 aa, Artificial Sequence
  Description of Artificial Sequence: Synthetic peptide
  Seed: VPCEPPEV (TP53 Y220C)
VMCEPPEM

SEQ ID NO: 22156 - protein, 8 aa, Artificial Sequence
  Description of Artificial Sequence: Synthetic peptide
  Seed: VPCEPPEV (TP53 Y220C)
VMCEPPEV

SEQ ID NO: 22157 - protein, 9 aa, Artificial Sequence
  Description of Artificial Sequence: Synthetic peptide
  Seed: VPCEPPEVG (TP53 Y220C)
VMCEPPEVA

SEQ ID NO: 22158 - protein, 9 aa, Artificial Sequence
  Description of Artificial Sequence: Synthetic peptide
  Seed: VPCEPPEVG (TP53 Y220C)
VMCEPPEVF

SEQ ID NO: 22159 - protein, 9 aa, Artificial Sequence
  Description of Artificial Sequence: Synthetic peptide
  Seed: VPCEPPEVG (TP53 Y220C)
VMCEPPEVL

SEQ ID NO: 22160 - protein, 9 aa, Artificial Sequence
  Description of Artificial Sequence: Synthetic peptide
  Seed: VPCEPPEVG (TP53 Y220C)
VMCEPPEVM

SEQ ID NO: 22161 - protein, 9 aa, Artificial Sequence
  Description of Artificial Sequence: Synthetic peptide
  Seed: VPCEPPEVG (TP53 Y220C)
VMCEPPEVY

SEQ ID NO: 22162 - protein, 9 aa, Artificial Sequence
  Description of Artificial Sequence: Synthetic peptide
  Seed: VVPCEPPEV (TP53 Y220C)
VMPCEPPEC

SEQ ID NO: 22163 - protein, 9 aa, Artificial Sequence
  Description of Artificial Sequence: Synthetic peptide
  Seed: VVPCEPPEV (TP53 Y220C)
VMPCEPPEF

SEQ ID NO: 22164 - protein, 9 aa, Artificial Sequence
  Description of Artificial Sequence: Synthetic peptide
  Seed: VVPCEPPEV (TP53 Y220C)
VMPCEPPEH

SEQ ID NO: 22165 - protein, 9 aa, Artificial Sequence
  Description of Artificial Sequence: Synthetic peptide
  Seed: VVPCEPPEV (TP53 Y220C)
VMPCEPPEK

SEQ ID NO: 22166 - protein, 9 aa, Artificial Sequence
  Description of Artificial Sequence: Synthetic peptide
  Seed: VVPCEPPEV (TP53 Y220C)
VMPCEPPER

SEQ ID NO: 22167 - protein, 9 aa, Artificial Sequence
  Description of Artificial Sequence: Synthetic peptide
  Seed: VVPCEPPEV (TP53 Y220C)
VMPCEPPET

SEQ ID NO: 22168 - protein, 9 aa, Artificial Sequence
  Description of Artificial Sequence: Synthetic peptide
  Seed: VVPCEPPEV (TP53 Y220C)
VMPCEPPEW

SEQ ID NO: 22169 - protein, 9 aa, Artificial Sequence
  Description of Artificial Sequence: Synthetic peptide
  Seed: VVPCEPPEV (TP53 Y220C)
VMPCEPPEY

SEQ ID NO: 22170 - protein, 10 aa, Artificial Sequence
  Description of Artificial Sequence: Synthetic peptide
  Seed: VVVPCEPPEV (TP53 Y220C)
VMVPCEPPEA

SEQ ID NO: 22171 - protein, 10 aa, Artificial Sequence
  Description of Artificial Sequence: Synthetic peptide
  Seed: VVVPCEPPEV (TP53 Y220C)
VMVPCEPPEF

SEQ ID NO: 22172 - protein, 10 aa, Artificial Sequence
  Description of Artificial Sequence: Synthetic peptide
  Seed: VVVPCEPPEV (TP53 Y220C)
VMVPCEPPEI

SEQ ID NO: 22173 - protein, 10 aa, Artificial Sequence
  Description of Artificial Sequence: Synthetic peptide
  Seed: VVVPCEPPEV (TP53 Y220C)
VMVPCEPPEL

SEQ ID NO: 22174 - protein, 10 aa, Artificial Sequence
  Description of Artificial Sequence: Synthetic peptide
  Seed: VVVPCEPPEV (TP53 Y220C)
VMVPCEPPEM

SEQ ID NO: 22175 - protein, 10 aa, Artificial Sequence
  Description of Artificial Sequence: Synthetic peptide
  Seed: VVVPCEPPEV (TP53 Y220C)
VMVPCEPPET

SEQ ID NO: 22176 - protein, 8 aa, Artificial Sequence
  Description of Artificial Sequence: Synthetic peptide
  Seed: VPCEPPEV (TP53 Y220C)
VNCEPPEI

SEQ ID NO: 22177 - protein, 8 aa, Artificial Sequence
  Description of Artificial Sequence: Synthetic peptide
  Seed: VPCEPPEV (TP53 Y220C)
VNCEPPEL

SEQ ID NO: 22178 - protein, 8 aa, Artificial Sequence
  Description of Artificial Sequence: Synthetic peptide
  Seed: VPCEPPEV (TP53 Y220C)
VNCEPPEV

SEQ ID NO: 22179 - protein, 9 aa, Artificial Sequence
  Description of Artificial Sequence: Synthetic peptide
  Seed: VPCEPPEVG (TP53 Y220C)
VNCEPPEVY

SEQ ID NO: 22180 - protein, 9 aa, Artificial Sequence
  Description of Artificial Sequence: Synthetic peptide
  Seed: VVPCEPPEV (TP53 Y220C)
VNPCEPPEF

SEQ ID NO: 22181 - protein, 9 aa, Artificial Sequence
  Description of Artificial Sequence: Synthetic peptide
  Seed: VVPCEPPEV (TP53 Y220C)
VNPCEPPEI

SEQ ID NO: 22182 - protein, 9 aa, Artificial Sequence
  Description of Artificial Sequence: Synthetic peptide
  Seed: VVPCEPPEV (TP53 Y220C)
VNPCEPPEK

SEQ ID NO: 22183 - protein, 9 aa, Artificial Sequence
  Description of Artificial Sequence: Synthetic peptide
  Seed: VVPCEPPEV (TP53 Y220C)
VNPCEPPEL

SEQ ID NO: 22184 - protein, 9 aa, Artificial Sequence
  Description of Artificial Sequence: Synthetic peptide
  Seed: VVPCEPPEV (TP53 Y220C)
VNPCEPPEM

SEQ ID NO: 22185 - protein, 9 aa, Artificial Sequence
  Description of Artificial Sequence: Synthetic peptide
  Seed: VVPCEPPEV (TP53 Y220C)
VNPCEPPER

SEQ ID NO: 22186 - protein, 9 aa, Artificial Sequence
  Description of Artificial Sequence: Synthetic peptide
  Seed: VVPCEPPEV (TP53 Y220C)
VNPCEPPEV

SEQ ID NO: 22187 - protein, 9 aa, Artificial Sequence
  Description of Artificial Sequence: Synthetic peptide
  Seed: VVPCEPPEV (TP53 Y220C)
VNPCEPPEY

SEQ ID NO: 22188 - protein, 10 aa, Artificial Sequence
  Description of Artificial Sequence: Synthetic peptide
  Seed: VVVPCEPPEV (TP53 Y220C)
VNVPCEPPEL

SEQ ID NO: 22189 - protein, 8 aa, Artificial Sequence
  Description of Artificial Sequence: Synthetic peptide
  Seed: VPCEPPEV (TP53 Y220C)
VPCEPPEA

SEQ ID NO: 22190 - protein, 8 aa, Artificial Sequence
  Description of Artificial Sequence: Synthetic peptide
  Seed: VPCEPPEV (TP53 Y220C)
VPCEPPEC

SEQ ID NO: 22191 - protein, 8 aa, Artificial Sequence
  Description of Artificial Sequence: Synthetic peptide
  Seed: VPCEPPEV (TP53 Y220C)
VPCEPPEF

SEQ ID NO: 22192 - protein, 8 aa, Artificial Sequence
  Description of Artificial Sequence: Synthetic peptide
  Seed: VPCEPPEV (TP53 Y220C)
VPCEPPEG

SEQ ID NO: 22193 - protein, 8 aa, Artificial Sequence
  Description of Artificial Sequence: Synthetic peptide
  Seed: VPCEPPEV (TP53 Y220C)
VPCEPPEI

SEQ ID NO: 22194 - protein, 8 aa, Artificial Sequence
  Description of Artificial Sequence: Synthetic peptide
  Seed: VPCEPPEV (TP53 Y220C)
VPCEPPEL

SEQ ID NO: 22195 - protein, 8 aa, Artificial Sequence
  Description of Artificial Sequence: Synthetic peptide
  Seed: VPCEPPEV (TP53 Y220C)
VPCEPPEM

SEQ ID NO: 22196 - protein, 8 aa, Artificial Sequence
  Description of Artificial Sequence: Synthetic peptide
  Seed: VPCEPPEV (TP53 Y220C)
VPCEPPEP

SEQ ID NO: 22197 - protein, 8 aa, Artificial Sequence
  Description of Artificial Sequence: Synthetic peptide
  Seed: VPCEPPEV (TP53 Y220C)
VPCEPPES

SEQ ID NO: 22198 - protein, 8 aa, Artificial Sequence
  Description of Artificial Sequence: Synthetic peptide
  Seed: VPCEPPEV (TP53 Y220C)
VPCEPPET

SEQ ID NO: 22199 - protein, 9 aa, Artificial Sequence
  Description of Artificial Sequence: Synthetic peptide
  Seed: VPCEPPEVG (TP53 Y220C)
VPCEPPEVC

SEQ ID NO: 22200 - protein, 9 aa, Artificial Sequence
  Description of Artificial Sequence: Synthetic peptide
  Seed: VPCEPPEVG (TP53 Y220C)
VPCEPPEVE

SEQ ID NO: 22201 - protein, 9 aa, Artificial Sequence
  Description of Artificial Sequence: Synthetic peptide
  Seed: VPCEPPEVG (TP53 Y220C)
VPCEPPEVF

SEQ ID NO: 22202 - protein, 10 aa, Artificial Sequence
  Description of Artificial Sequence: Synthetic peptide
  Seed: VPCEPPEVGS (TP53 Y220C)
VPCEPPEVGA

SEQ ID NO: 22203 - protein, 10 aa, Artificial Sequence
  Description of Artificial Sequence: Synthetic peptide
  Seed: VPCEPPEVGS (TP53 Y220C)
VPCEPPEVGC

SEQ ID NO: 22204 - protein, 10 aa, Artificial Sequence
  Description of Artificial Sequence: Synthetic peptide
  Seed: VPCEPPEVGS (TP53 Y220C)
VPCEPPEVGF

SEQ ID NO: 22205 - protein, 10 aa, Artificial Sequence
  Description of Artificial Sequence: Synthetic peptide
  Seed: VPCEPPEVGS (TP53 Y220C)
VPCEPPEVGG

SEQ ID NO: 22206 - protein, 10 aa, Artificial Sequence
  Description of Artificial Sequence: Synthetic peptide
  Seed: VPCEPPEVGS (TP53 Y220C)
VPCEPPEVGI

SEQ ID NO: 22207 - protein, 10 aa, Artificial Sequence
  Description of Artificial Sequence: Synthetic peptide
  Seed: VPCEPPEVGS (TP53 Y220C)
VPCEPPEVGK

SEQ ID NO: 22208 - protein, 10 aa, Artificial Sequence
  Description of Artificial Sequence: Synthetic peptide
  Seed: VPCEPPEVGS (TP53 Y220C)
VPCEPPEVGL

SEQ ID NO: 22209 - protein, 10 aa, Artificial Sequence
  Description of Artificial Sequence: Synthetic peptide
  Seed: VPCEPPEVGS (TP53 Y220C)
VPCEPPEVGM

SEQ ID NO: 22210 - protein, 10 aa, Artificial Sequence
  Description of Artificial Sequence: Synthetic peptide
  Seed: VPCEPPEVGS (TP53 Y220C)
VPCEPPEVGP

SEQ ID NO: 22211 - protein, 10 aa, Artificial Sequence
  Description of Artificial Sequence: Synthetic peptide
  Seed: VPCEPPEVGS (TP53 Y220C)
VPCEPPEVGR

SEQ ID NO: 22212 - protein, 10 aa, Artificial Sequence
  Description of Artificial Sequence: Synthetic peptide
  Seed: VPCEPPEVGS (TP53 Y220C)
VPCEPPEVGT

SEQ ID NO: 22213 - protein, 10 aa, Artificial Sequence
  Description of Artificial Sequence: Synthetic peptide
  Seed: VPCEPPEVGS (TP53 Y220C)
VPCEPPEVGV

SEQ ID NO: 22214 - protein, 10 aa, Artificial Sequence
  Description of Artificial Sequence: Synthetic peptide
  Seed: VPCEPPEVGS (TP53 Y220C)
VPCEPPEVGW

SEQ ID NO: 22215 - protein, 10 aa, Artificial Sequence
  Description of Artificial Sequence: Synthetic peptide
  Seed: VPCEPPEVGS (TP53 Y220C)
VPCEPPEVGY

SEQ ID NO: 22216 - protein, 9 aa, Artificial Sequence
  Description of Artificial Sequence: Synthetic peptide
  Seed: VPCEPPEVG (TP53 Y220C)
VPCEPPEVH

SEQ ID NO: 22217 - protein, 9 aa, Artificial Sequence
  Description of Artificial Sequence: Synthetic peptide
  Seed: VPCEPPEVG (TP53 Y220C)
VPCEPPEVI

SEQ ID NO: 22218 - protein, 9 aa, Artificial Sequence
  Description of Artificial Sequence: Synthetic peptide
  Seed: VPCEPPEVG (TP53 Y220C)
VPCEPPEVK

SEQ ID NO: 22219 - protein, 9 aa, Artificial Sequence
  Description of Artificial Sequence: Synthetic peptide
  Seed: VPCEPPEVG (TP53 Y220C)
VPCEPPEVL

SEQ ID NO: 22220 - protein, 9 aa, Artificial Sequence
  Description of Artificial Sequence: Synthetic peptide
  Seed: VPCEPPEVG (TP53 Y220C)
VPCEPPEVN

SEQ ID NO: 22221 - protein, 9 aa, Artificial Sequence
  Description of Artificial Sequence: Synthetic peptide
  Seed: VPCEPPEVG (TP53 Y220C)
VPCEPPEVP

SEQ ID NO: 22222 - protein, 9 aa, Artificial Sequence
  Description of Artificial Sequence: Synthetic peptide
  Seed: VPCEPPEVG (TP53 Y220C)
VPCEPPEVQ

SEQ ID NO: 22223 - protein, 9 aa, Artificial Sequence
  Description of Artificial Sequence: Synthetic peptide
  Seed: VPCEPPEVG (TP53 Y220C)
VPCEPPEVR

SEQ ID NO: 22224 - protein, 9 aa, Artificial Sequence
  Description of Artificial Sequence: Synthetic peptide
  Seed: VPCEPPEVG (TP53 Y220C)
VPCEPPEVS

SEQ ID NO: 22225 - protein, 9 aa, Artificial Sequence
  Description of Artificial Sequence: Synthetic peptide
  Seed: VPCEPPEVG (TP53 Y220C)
VPCEPPEVT

SEQ ID NO: 22226 - protein, 9 aa, Artificial Sequence
  Description of Artificial Sequence: Synthetic peptide
  Seed: VPCEPPEVG (TP53 Y220C)
VPCEPPEVV

SEQ ID NO: 22227 - protein, 9 aa, Artificial Sequence
  Description of Artificial Sequence: Synthetic peptide
  Seed: VPCEPPEVG (TP53 Y220C)
VPCEPPEVW

SEQ ID NO: 22228 - protein, 9 aa, Artificial Sequence
  Description of Artificial Sequence: Synthetic peptide
  Seed: VPCEPPEVG (TP53 Y220C)
VPCEPPEVY

SEQ ID NO: 22229 - protein, 8 aa, Artificial Sequence
  Description of Artificial Sequence: Synthetic peptide
  Seed: VPCEPPEV (TP53 Y220C)
VPCEPPEW

SEQ ID NO: 22230 - protein, 8 aa, Artificial Sequence
  Description of Artificial Sequence: Synthetic peptide
  Seed: VPCEPPEV (TP53 Y220C)
VPCEPPEY

SEQ ID NO: 22231 - protein, 9 aa, Artificial Sequence
  Description of Artificial Sequence: Synthetic peptide
  Seed: VVPCEPPEV (TP53 Y220C)
VPPCEPPEA

SEQ ID NO: 22232 - protein, 9 aa, Artificial Sequence
  Description of Artificial Sequence: Synthetic peptide
  Seed: VVPCEPPEV (TP53 Y220C)
VPPCEPPEC

SEQ ID NO: 22233 - protein, 9 aa, Artificial Sequence
  Description of Artificial Sequence: Synthetic peptide
  Seed: VVPCEPPEV (TP53 Y220C)
VPPCEPPEF

SEQ ID NO: 22234 - protein, 9 aa, Artificial Sequence
  Description of Artificial Sequence: Synthetic peptide
  Seed: VVPCEPPEV (TP53 Y220C)
VPPCEPPEI

SEQ ID NO: 22235 - protein, 9 aa, Artificial Sequence
  Description of Artificial Sequence: Synthetic peptide
  Seed: VVPCEPPEV (TP53 Y220C)
VPPCEPPEK

SEQ ID NO: 22236 - protein, 9 aa, Artificial Sequence
  Description of Artificial Sequence: Synthetic peptide
  Seed: VVPCEPPEV (TP53 Y220C)
VPPCEPPEL

SEQ ID NO: 22237 - protein, 9 aa, Artificial Sequence
  Description of Artificial Sequence: Synthetic peptide
  Seed: VVPCEPPEV (TP53 Y220C)
VPPCEPPEM

SEQ ID NO: 22238 - protein, 9 aa, Artificial Sequence
  Description of Artificial Sequence: Synthetic peptide
  Seed: VVPCEPPEV (TP53 Y220C)
VPPCEPPET

SEQ ID NO: 22239 - protein, 9 aa, Artificial Sequence
  Description of Artificial Sequence: Synthetic peptide
  Seed: VVPCEPPEV (TP53 Y220C)
VPPCEPPEV

SEQ ID NO: 22240 - protein, 9 aa, Artificial Sequence
  Description of Artificial Sequence: Synthetic peptide
  Seed: VVPCEPPEV (TP53 Y220C)
VPPCEPPEY

SEQ ID NO: 22241 - protein, 8 aa, Artificial Sequence
  Description of Artificial Sequence: Synthetic peptide
  Seed: VPCEPPEV (TP53 Y220C)
VQCEPPEF

SEQ ID NO: 22242 - protein, 8 aa, Artificial Sequence
  Description of Artificial Sequence: Synthetic peptide
  Seed: VPCEPPEV (TP53 Y220C)
VQCEPPEI

SEQ ID NO: 22243 - protein, 8 aa, Artificial Sequence
  Description of Artificial Sequence: Synthetic peptide
  Seed: VPCEPPEV (TP53 Y220C)
VQCEPPEL

SEQ ID NO: 22244 - protein, 8 aa, Artificial Sequence
  Description of Artificial Sequence: Synthetic peptide
  Seed: VPCEPPEV (TP53 Y220C)
VQCEPPEM

SEQ ID NO: 22245 - protein, 8 aa, Artificial Sequence
  Description of Artificial Sequence: Synthetic peptide
  Seed: VPCEPPEV (TP53 Y220C)
VQCEPPEV

SEQ ID NO: 22246 - protein, 9 aa, Artificial Sequence
  Description of Artificial Sequence: Synthetic peptide
  Seed: VPCEPPEVG (TP53 Y220C)
VQCEPPEVF

SEQ ID NO: 22247 - protein, 9 aa, Artificial Sequence
  Description of Artificial Sequence: Synthetic peptide
  Seed: VPCEPPEVG (TP53 Y220C)
VQCEPPEVY

SEQ ID NO: 22248 - protein, 9 aa, Artificial Sequence
  Description of Artificial Sequence: Synthetic peptide
  Seed: VVPCEPPEV (TP53 Y220C)
VQPCEPPEA

SEQ ID NO: 22249 - protein, 9 aa, Artificial Sequence
  Description of Artificial Sequence: Synthetic peptide
  Seed: VVPCEPPEV (TP53 Y220C)
VQPCEPPEF

SEQ ID NO: 22250 - protein, 9 aa, Artificial Sequence
  Description of Artificial Sequence: Synthetic peptide
  Seed: VVPCEPPEV (TP53 Y220C)
VQPCEPPEH

SEQ ID NO: 22251 - protein, 9 aa, Artificial Sequence
  Description of Artificial Sequence: Synthetic peptide
  Seed: VVPCEPPEV (TP53 Y220C)
VQPCEPPEI

SEQ ID NO: 22252 - protein, 9 aa, Artificial Sequence
  Description of Artificial Sequence: Synthetic peptide
  Seed: VVPCEPPEV (TP53 Y220C)
VQPCEPPEK

SEQ ID NO: 22253 - protein, 9 aa, Artificial Sequence
  Description of Artificial Sequence: Synthetic peptide
  Seed: VVPCEPPEV (TP53 Y220C)
VQPCEPPEL

SEQ ID NO: 22254 - protein, 9 aa, Artificial Sequence
  Description of Artificial Sequence: Synthetic peptide
  Seed: VVPCEPPEV (TP53 Y220C)
VQPCEPPEM

SEQ ID NO: 22255 - protein, 9 aa, Artificial Sequence
  Description of Artificial Sequence: Synthetic peptide
  Seed: VVPCEPPEV (TP53 Y220C)
VQPCEPPER

SEQ ID NO: 22256 - protein, 9 aa, Artificial Sequence
  Description of Artificial Sequence: Synthetic peptide
  Seed: VVPCEPPEV (TP53 Y220C)
VQPCEPPEW

SEQ ID NO: 22257 - protein, 9 aa, Artificial Sequence
  Description of Artificial Sequence: Synthetic peptide
  Seed: VVPCEPPEV (TP53 Y220C)
VQPCEPPEY

SEQ ID NO: 22258 - protein, 10 aa, Artificial Sequence
  Description of Artificial Sequence: Synthetic peptide
  Seed: VVVPCEPPEV (TP53 Y220C)
VQVPCEPPEA

SEQ ID NO: 22259 - protein, 10 aa, Artificial Sequence
  Description of Artificial Sequence: Synthetic peptide
  Seed: VVVPCEPPEV (TP53 Y220C)
VQVPCEPPEC

SEQ ID NO: 22260 - protein, 10 aa, Artificial Sequence
  Description of Artificial Sequence: Synthetic peptide
  Seed: VVVPCEPPEV (TP53 Y220C)
VQVPCEPPEF

SEQ ID NO: 22261 - protein, 10 aa, Artificial Sequence
  Description of Artificial Sequence: Synthetic peptide
  Seed: VVVPCEPPEV (TP53 Y220C)
VQVPCEPPEI

SEQ ID NO: 22262 - protein, 10 aa, Artificial Sequence
  Description of Artificial Sequence: Synthetic peptide
  Seed: VVVPCEPPEV (TP53 Y220C)
VQVPCEPPEL

SEQ ID NO: 22263 - protein, 10 aa, Artificial Sequence
  Description of Artificial Sequence: Synthetic peptide
  Seed: VVVPCEPPEV (TP53 Y220C)
VQVPCEPPEM

SEQ ID NO: 22264 - protein, 10 aa, Artificial Sequence
  Description of Artificial Sequence: Synthetic peptide
  Seed: VVVPCEPPEV (TP53 Y220C)
VQVPCEPPEW

SEQ ID NO: 22265 - protein, 9 aa, Artificial Sequence
  Description of Artificial Sequence: Synthetic peptide
  Seed: VVPCEPPEV (TP53 Y220C)
VRPCEPPEA

SEQ ID NO: 22266 - protein, 9 aa, Artificial Sequence
  Description of Artificial Sequence: Synthetic peptide
  Seed: VVPCEPPEV (TP53 Y220C)
VRPCEPPEC

SEQ ID NO: 22267 - protein, 9 aa, Artificial Sequence
  Description of Artificial Sequence: Synthetic peptide
  Seed: VVPCEPPEV (TP53 Y220C)
VRPCEPPEF

SEQ ID NO: 22268 - protein, 9 aa, Artificial Sequence
  Description of Artificial Sequence: Synthetic peptide
  Seed: VVPCEPPEV (TP53 Y220C)
VRPCEPPEI

SEQ ID NO: 22269 - protein, 9 aa, Artificial Sequence
  Description of Artificial Sequence: Synthetic peptide
  Seed: VVPCEPPEV (TP53 Y220C)
VRPCEPPEL

SEQ ID NO: 22270 - protein, 9 aa, Artificial Sequence
  Description of Artificial Sequence: Synthetic peptide
  Seed: VVPCEPPEV (TP53 Y220C)
VRPCEPPEM

SEQ ID NO: 22271 - protein, 9 aa, Artificial Sequence
  Description of Artificial Sequence: Synthetic peptide
  Seed: VVPCEPPEV (TP53 Y220C)
VRPCEPPEV

SEQ ID NO: 22272 - protein, 9 aa, Artificial Sequence
  Description of Artificial Sequence: Synthetic peptide
  Seed: VVPCEPPEV (TP53 Y220C)
VRPCEPPEY

SEQ ID NO: 22273 - protein, 8 aa, Artificial Sequence
  Description of Artificial Sequence: Synthetic peptide
  Seed: VPCEPPEV (TP53 Y220C)
VSCEPPEF

SEQ ID NO: 22274 - protein, 8 aa, Artificial Sequence
  Description of Artificial Sequence: Synthetic peptide
  Seed: VPCEPPEV (TP53 Y220C)
VSCEPPEI

SEQ ID NO: 22275 - protein, 8 aa, Artificial Sequence
  Description of Artificial Sequence: Synthetic peptide
  Seed: VPCEPPEV (TP53 Y220C)
VSCEPPEL

SEQ ID NO: 22276 - protein, 8 aa, Artificial Sequence
  Description of Artificial Sequence: Synthetic peptide
  Seed: VPCEPPEV (TP53 Y220C)
VSCEPPEM

SEQ ID NO: 22277 - protein, 8 aa, Artificial Sequence
  Description of Artificial Sequence: Synthetic peptide
  Seed: VPCEPPEV (TP53 Y220C)
VSCEPPEV

SEQ ID NO: 22278 - protein, 9 aa, Artificial Sequence
  Description of Artificial Sequence: Synthetic peptide
  Seed: VPCEPPEVG (TP53 Y220C)
VSCEPPEVA

SEQ ID NO: 22279 - protein, 9 aa, Artificial Sequence
  Description of Artificial Sequence: Synthetic peptide
  Seed: VPCEPPEVG (TP53 Y220C)
VSCEPPEVF

SEQ ID NO: 22280 - protein, 9 aa, Artificial Sequence
  Description of Artificial Sequence: Synthetic peptide
  Seed: VPCEPPEVG (TP53 Y220C)
VSCEPPEVI

SEQ ID NO: 22281 - protein, 9 aa, Artificial Sequence
  Description of Artificial Sequence: Synthetic peptide
  Seed: VPCEPPEVG (TP53 Y220C)
VSCEPPEVL

SEQ ID NO: 22282 - protein, 9 aa, Artificial Sequence
  Description of Artificial Sequence: Synthetic peptide
  Seed: VPCEPPEVG (TP53 Y220C)
VSCEPPEVM

SEQ ID NO: 22283 - protein, 9 aa, Artificial Sequence
  Description of Artificial Sequence: Synthetic peptide
  Seed: VPCEPPEVG (TP53 Y220C)
VSCEPPEVV

SEQ ID NO: 22284 - protein, 9 aa, Artificial Sequence
  Description of Artificial Sequence: Synthetic peptide
  Seed: VPCEPPEVG (TP53 Y220C)
VSCEPPEVY

SEQ ID NO: 22285 - protein, 9 aa, Artificial Sequence
  Description of Artificial Sequence: Synthetic peptide
  Seed: VVPCEPPEV (TP53 Y220C)
VSPCEPPEA

SEQ ID NO: 22286 - protein, 9 aa, Artificial Sequence
  Description of Artificial Sequence: Synthetic peptide
  Seed: VVPCEPPEV (TP53 Y220C)
VSPCEPPEC

SEQ ID NO: 22287 - protein, 9 aa, Artificial Sequence
  Description of Artificial Sequence: Synthetic peptide
  Seed: VVPCEPPEV (TP53 Y220C)
VSPCEPPEF

SEQ ID NO: 22288 - protein, 9 aa, Artificial Sequence
  Description of Artificial Sequence: Synthetic peptide
  Seed: VVPCEPPEV (TP53 Y220C)
VSPCEPPEH

SEQ ID NO: 22289 - protein, 9 aa, Artificial Sequence
  Description of Artificial Sequence: Synthetic peptide
  Seed: VVPCEPPEV (TP53 Y220C)
VSPCEPPEI

SEQ ID NO: 22290 - protein, 9 aa, Artificial Sequence
  Description of Artificial Sequence: Synthetic peptide
  Seed: VVPCEPPEV (TP53 Y220C)
VSPCEPPEK

SEQ ID NO: 22291 - protein, 9 aa, Artificial Sequence
  Description of Artificial Sequence: Synthetic peptide
  Seed: VVPCEPPEV (TP53 Y220C)
VSPCEPPEL

SEQ ID NO: 22292 - protein, 9 aa, Artificial Sequence
  Description of Artificial Sequence: Synthetic peptide
  Seed: VVPCEPPEV (TP53 Y220C)
VSPCEPPEM

SEQ ID NO: 22293 - protein, 9 aa, Artificial Sequence
  Description of Artificial Sequence: Synthetic peptide
  Seed: VVPCEPPEV (TP53 Y220C)
VSPCEPPER

SEQ ID NO: 22294 - protein, 9 aa, Artificial Sequence
  Description of Artificial Sequence: Synthetic peptide
  Seed: VVPCEPPEV (TP53 Y220C)
VSPCEPPEV

SEQ ID NO: 22295 - protein, 9 aa, Artificial Sequence
  Description of Artificial Sequence: Synthetic peptide
  Seed: VVPCEPPEV (TP53 Y220C)
VSPCEPPEW

SEQ ID NO: 22296 - protein, 9 aa, Artificial Sequence
  Description of Artificial Sequence: Synthetic peptide
  Seed: VVPCEPPEV (TP53 Y220C)
VSPCEPPEY

SEQ ID NO: 22297 - protein, 10 aa, Artificial Sequence
  Description of Artificial Sequence: Synthetic peptide
  Seed: VVVPCEPPEV (TP53 Y220C)
VSVPCEPPEF

SEQ ID NO: 22298 - protein, 10 aa, Artificial Sequence
  Description of Artificial Sequence: Synthetic peptide
  Seed: VVVPCEPPEV (TP53 Y220C)
VSVPCEPPEI

SEQ ID NO: 22299 - protein, 10 aa, Artificial Sequence
  Description of Artificial Sequence: Synthetic peptide
  Seed: VVVPCEPPEV (TP53 Y220C)
VSVPCEPPEL

SEQ ID NO: 22300 - protein, 10 aa, Artificial Sequence
  Description of Artificial Sequence: Synthetic peptide
  Seed: VVVPCEPPEV (TP53 Y220C)
VSVPCEPPEM

SEQ ID NO: 22301 - protein, 10 aa, Artificial Sequence
  Description of Artificial Sequence: Synthetic peptide
  Seed: VVVPCEPPEV (TP53 Y220C)
VSVPCEPPEV

SEQ ID NO: 22302 - protein, 8 aa, Artificial Sequence
  Description of Artificial Sequence: Synthetic peptide
  Seed: VPCEPPEV (TP53 Y220C)
VTCEPPEF

SEQ ID NO: 22303 - protein, 8 aa, Artificial Sequence
  Description of Artificial Sequence: Synthetic peptide
  Seed: VPCEPPEV (TP53 Y220C)
VTCEPPEI

SEQ ID NO: 22304 - protein, 8 aa, Artificial Sequence
  Description of Artificial Sequence: Synthetic peptide
  Seed: VPCEPPEV (TP53 Y220C)
VTCEPPEL

SEQ ID NO: 22305 - protein, 8 aa, Artificial Sequence
  Description of Artificial Sequence: Synthetic peptide
  Seed: VPCEPPEV (TP53 Y220C)
VTCEPPEM

SEQ ID NO: 22306 - protein, 8 aa, Artificial Sequence
  Description of Artificial Sequence: Synthetic peptide
  Seed: VPCEPPEV (TP53 Y220C)
VTCEPPEV

SEQ ID NO: 22307 - protein, 9 aa, Artificial Sequence
  Description of Artificial Sequence: Synthetic peptide
  Seed: VPCEPPEVG (TP53 Y220C)
VTCEPPEVA

SEQ ID NO: 22308 - protein, 9 aa, Artificial Sequence
  Description of Artificial Sequence: Synthetic peptide
  Seed: VPCEPPEVG (TP53 Y220C)
VTCEPPEVF

SEQ ID NO: 22309 - protein, 9 aa, Artificial Sequence
  Description of Artificial Sequence: Synthetic peptide
  Seed: VPCEPPEVG (TP53 Y220C)
VTCEPPEVI

SEQ ID NO: 22310 - protein, 9 aa, Artificial Sequence
  Description of Artificial Sequence: Synthetic peptide
  Seed: VPCEPPEVG (TP53 Y220C)
VTCEPPEVL

SEQ ID NO: 22311 - protein, 9 aa, Artificial Sequence
  Description of Artificial Sequence: Synthetic peptide
  Seed: VPCEPPEVG (TP53 Y220C)
VTCEPPEVM

SEQ ID NO: 22312 - protein, 9 aa, Artificial Sequence
  Description of Artificial Sequence: Synthetic peptide
  Seed: VPCEPPEVG (TP53 Y220C)
VTCEPPEVV

SEQ ID NO: 22313 - protein, 9 aa, Artificial Sequence
  Description of Artificial Sequence: Synthetic peptide
  Seed: VPCEPPEVG (TP53 Y220C)
VTCEPPEVY

SEQ ID NO: 22314 - protein, 9 aa, Artificial Sequence
  Description of Artificial Sequence: Synthetic peptide
  Seed: VVPCEPPEV (TP53 Y220C)
VTPCEPPEA

SEQ ID NO: 22315 - protein, 9 aa, Artificial Sequence
  Description of Artificial Sequence: Synthetic peptide
  Seed: VVPCEPPEV (TP53 Y220C)
VTPCEPPEC

SEQ ID NO: 22316 - protein, 9 aa, Artificial Sequence
  Description of Artificial Sequence: Synthetic peptide
  Seed: VVPCEPPEV (TP53 Y220C)
VTPCEPPEF

SEQ ID NO: 22317 - protein, 9 aa, Artificial Sequence
  Description of Artificial Sequence: Synthetic peptide
  Seed: VVPCEPPEV (TP53 Y220C)
VTPCEPPEH

SEQ ID NO: 22318 - protein, 9 aa, Artificial Sequence
  Description of Artificial Sequence: Synthetic peptide
  Seed: VVPCEPPEV (TP53 Y220C)
VTPCEPPEI

SEQ ID NO: 22319 - protein, 9 aa, Artificial Sequence
  Description of Artificial Sequence: Synthetic peptide
  Seed: VVPCEPPEV (TP53 Y220C)
VTPCEPPEK

SEQ ID NO: 22320 - protein, 9 aa, Artificial Sequence
  Description of Artificial Sequence: Synthetic peptide
  Seed: VVPCEPPEV (TP53 Y220C)
VTPCEPPEL

SEQ ID NO: 22321 - protein, 9 aa, Artificial Sequence
  Description of Artificial Sequence: Synthetic peptide
  Seed: VVPCEPPEV (TP53 Y220C)
VTPCEPPEM

SEQ ID NO: 22322 - protein, 9 aa, Artificial Sequence
  Description of Artificial Sequence: Synthetic peptide
  Seed: VVPCEPPEV (TP53 Y220C)
VTPCEPPER

SEQ ID NO: 22323 - protein, 9 aa, Artificial Sequence
  Description of Artificial Sequence: Synthetic peptide
  Seed: VVPCEPPEV (TP53 Y220C)
VTPCEPPEW

SEQ ID NO: 22324 - protein, 9 aa, Artificial Sequence
  Description of Artificial Sequence: Synthetic peptide
  Seed: VVPCEPPEV (TP53 Y220C)
VTPCEPPEY

SEQ ID NO: 22325 - protein, 10 aa, Artificial Sequence
  Description of Artificial Sequence: Synthetic peptide
  Seed: VVVPCEPPEV (TP53 Y220C)
VTVPCEPPEF

SEQ ID NO: 22326 - protein, 10 aa, Artificial Sequence
  Description of Artificial Sequence: Synthetic peptide
  Seed: VVVPCEPPEV (TP53 Y220C)
VTVPCEPPEI

SEQ ID NO: 22327 - protein, 10 aa, Artificial Sequence
  Description of Artificial Sequence: Synthetic peptide
  Seed: VVVPCEPPEV (TP53 Y220C)
VTVPCEPPEL

SEQ ID NO: 22328 - protein, 10 aa, Artificial Sequence
  Description of Artificial Sequence: Synthetic peptide
  Seed: VVVPCEPPEV (TP53 Y220C)
VTVPCEPPEM

SEQ ID NO: 22329 - protein, 10 aa, Artificial Sequence
  Description of Artificial Sequence: Synthetic peptide
  Seed: VVVPCEPPEV (TP53 Y220C)
VTVPCEPPEV

SEQ ID NO: 22330 - protein, 8 aa, Artificial Sequence
  Description of Artificial Sequence: Synthetic peptide
  Seed: VPCEPPEV (TP53 Y220C)
VVCEPPEF

SEQ ID NO: 22331 - protein, 8 aa, Artificial Sequence
  Description of Artificial Sequence: Synthetic peptide
  Seed: VPCEPPEV (TP53 Y220C)
VVCEPPEI

SEQ ID NO: 22332 - protein, 8 aa, Artificial Sequence
  Description of Artificial Sequence: Synthetic peptide
  Seed: VPCEPPEV (TP53 Y220C)
VVCEPPEL

SEQ ID NO: 22333 - protein, 8 aa, Artificial Sequence
  Description of Artificial Sequence: Synthetic peptide
  Seed: VPCEPPEV (TP53 Y220C)
VVCEPPEM

SEQ ID NO: 22334 - protein, 8 aa, Artificial Sequence
  Description of Artificial Sequence: Synthetic peptide
  Seed: VPCEPPEV (TP53 Y220C)
VVCEPPEV

SEQ ID NO: 22335 - protein, 9 aa, Artificial Sequence
  Description of Artificial Sequence: Synthetic peptide
  Seed: VPCEPPEVG (TP53 Y220C)
VVCEPPEVA

SEQ ID NO: 22336 - protein, 9 aa, Artificial Sequence
  Description of Artificial Sequence: Synthetic peptide
  Seed: VPCEPPEVG (TP53 Y220C)
VVCEPPEVF

SEQ ID NO: 22337 - protein, 9 aa, Artificial Sequence
  Description of Artificial Sequence: Synthetic peptide
  Seed: VPCEPPEVG (TP53 Y220C)
VVCEPPEVI

SEQ ID NO: 22338 - protein, 9 aa, Artificial Sequence
  Description of Artificial Sequence: Synthetic peptide
  Seed: VPCEPPEVG (TP53 Y220C)
VVCEPPEVL

SEQ ID NO: 22339 - protein, 9 aa, Artificial Sequence
  Description of Artificial Sequence: Synthetic peptide
  Seed: VPCEPPEVG (TP53 Y220C)
VVCEPPEVM

SEQ ID NO: 22340 - protein, 9 aa, Artificial Sequence
  Description of Artificial Sequence: Synthetic peptide
  Seed: VPCEPPEVG (TP53 Y220C)
VVCEPPEVV

SEQ ID NO: 22341 - protein, 9 aa, Artificial Sequence
  Description of Artificial Sequence: Synthetic peptide
  Seed: VPCEPPEVG (TP53 Y220C)
VVCEPPEVW

SEQ ID NO: 22342 - protein, 9 aa, Artificial Sequence
  Description of Artificial Sequence: Synthetic peptide
  Seed: VPCEPPEVG (TP53 Y220C)
VVCEPPEVY

SEQ ID NO: 22343 - protein, 9 aa, Artificial Sequence
  Description of Artificial Sequence: Synthetic peptide
  Seed: VVPCEPPEV (TP53 Y220C)
VVPCEPPEA

SEQ ID NO: 22344 - protein, 9 aa, Artificial Sequence
  Description of Artificial Sequence: Synthetic peptide
  Seed: VVPCEPPEV (TP53 Y220C)
VVPCEPPEC

SEQ ID NO: 22345 - protein, 9 aa, Artificial Sequence
  Description of Artificial Sequence: Synthetic peptide
  Seed: VVPCEPPEV (TP53 Y220C)
VVPCEPPEF

SEQ ID NO: 22346 - protein, 9 aa, Artificial Sequence
  Description of Artificial Sequence: Synthetic peptide
  Seed: VVPCEPPEV (TP53 Y220C)
VVPCEPPEH

SEQ ID NO: 22347 - protein, 9 aa, Artificial Sequence
  Description of Artificial Sequence: Synthetic peptide
  Seed: VVPCEPPEV (TP53 Y220C)
VVPCEPPEK

SEQ ID NO: 22348 - protein, 9 aa, Artificial Sequence
  Description of Artificial Sequence: Synthetic peptide
  Seed: VVPCEPPEV (TP53 Y220C)
VVPCEPPEL

SEQ ID NO: 22349 - protein, 9 aa, Artificial Sequence
  Description of Artificial Sequence: Synthetic peptide
  Seed: VVPCEPPEV (TP53 Y220C)
VVPCEPPEM

SEQ ID NO: 22350 - protein, 9 aa, Artificial Sequence
  Description of Artificial Sequence: Synthetic peptide
  Seed: VVPCEPPEV (TP53 Y220C)
VVPCEPPER

SEQ ID NO: 22351 - protein, 9 aa, Artificial Sequence
  Description of Artificial Sequence: Synthetic peptide
  Seed: VVPCEPPEV (TP53 Y220C)
VVPCEPPEW

SEQ ID NO: 22352 - protein, 9 aa, Artificial Sequence
  Description of Artificial Sequence: Synthetic peptide
  Seed: VVPCEPPEV (TP53 Y220C)
VVPCEPPEY

SEQ ID NO: 22353 - protein, 10 aa, Artificial Sequence
  Description of Artificial Sequence: Synthetic peptide
  Seed: VVVPCEPPEV (TP53 Y220C)
VVVPCEPPEA

SEQ ID NO: 22354 - protein, 10 aa, Artificial Sequence
  Description of Artificial Sequence: Synthetic peptide
  Seed: VVVPCEPPEV (TP53 Y220C)
VVVPCEPPEF

SEQ ID NO: 22355 - protein, 10 aa, Artificial Sequence
  Description of Artificial Sequence: Synthetic peptide
  Seed: VVVPCEPPEV (TP53 Y220C)
VVVPCEPPEI

SEQ ID NO: 22356 - protein, 10 aa, Artificial Sequence
  Description of Artificial Sequence: Synthetic peptide
  Seed: VVVPCEPPEV (TP53 Y220C)
VVVPCEPPEL

SEQ ID NO: 22357 - protein, 10 aa, Artificial Sequence
  Description of Artificial Sequence: Synthetic peptide
  Seed: VVVPCEPPEV (TP53 Y220C)
VVVPCEPPEM

SEQ ID NO: 22358 - protein, 8 aa, Artificial Sequence
  Description of Artificial Sequence: Synthetic peptide
  Seed: VPCEPPEV (TP53 Y220C)
VWCEPPEL

SEQ ID NO: 22359 - protein, 9 aa, Artificial Sequence
  Description of Artificial Sequence: Synthetic peptide
  Seed: VVPCEPPEV (TP53 Y220C)
VWPCEPPEC

SEQ ID NO: 22360 - protein, 9 aa, Artificial Sequence
  Description of Artificial Sequence: Synthetic peptide
  Seed: VVPCEPPEV (TP53 Y220C)
VWPCEPPEF

SEQ ID NO: 22361 - protein, 9 aa, Artificial Sequence
  Description of Artificial Sequence: Synthetic peptide
  Seed: VVPCEPPEV (TP53 Y220C)
VWPCEPPEI

SEQ ID NO: 22362 - protein, 9 aa, Artificial Sequence
  Description of Artificial Sequence: Synthetic peptide
  Seed: VVPCEPPEV (TP53 Y220C)
VWPCEPPEL

SEQ ID NO: 22363 - protein, 9 aa, Artificial Sequence
  Description of Artificial Sequence: Synthetic peptide
  Seed: VVPCEPPEV (TP53 Y220C)
VWPCEPPEM

SEQ ID NO: 22364 - protein, 9 aa, Artificial Sequence
  Description of Artificial Sequence: Synthetic peptide
  Seed: VVPCEPPEV (TP53 Y220C)
VWPCEPPEV

SEQ ID NO: 22365 - protein, 9 aa, Artificial Sequence
  Description of Artificial Sequence: Synthetic peptide
  Seed: VVPCEPPEV (TP53 Y220C)
VWPCEPPEY

SEQ ID NO: 22366 - protein, 8 aa, Artificial Sequence
  Description of Artificial Sequence: Synthetic peptide
  Seed: VPCEPPEV (TP53 Y220C)
VYCEPPEI

SEQ ID NO: 22367 - protein, 8 aa, Artificial Sequence
  Description of Artificial Sequence: Synthetic peptide
  Seed: VPCEPPEV (TP53 Y220C)
VYCEPPEL

SEQ ID NO: 22368 - protein, 8 aa, Artificial Sequence
  Description of Artificial Sequence: Synthetic peptide
  Seed: VPCEPPEV (TP53 Y220C)
VYCEPPEV

SEQ ID NO: 22369 - protein, 9 aa, Artificial Sequence
  Description of Artificial Sequence: Synthetic peptide
  Seed: VPCEPPEVG (TP53 Y220C)
VYCEPPEVF

SEQ ID NO: 22370 - protein, 9 aa, Artificial Sequence
  Description of Artificial Sequence: Synthetic peptide
  Seed: VPCEPPEVG (TP53 Y220C)
VYCEPPEVY

SEQ ID NO: 22371 - protein, 9 aa, Artificial Sequence
  Description of Artificial Sequence: Synthetic peptide
  Seed: VVPCEPPEV (TP53 Y220C)
VYPCEPPEA

SEQ ID NO: 22372 - protein, 9 aa, Artificial Sequence
  Description of Artificial Sequence: Synthetic peptide
  Seed: VVPCEPPEV (TP53 Y220C)
VYPCEPPEC

SEQ ID NO: 22373 - protein, 9 aa, Artificial Sequence
  Description of Artificial Sequence: Synthetic peptide
  Seed: VVPCEPPEV (TP53 Y220C)
VYPCEPPEF

SEQ ID NO: 22374 - protein, 9 aa, Artificial Sequence
  Description of Artificial Sequence: Synthetic peptide
  Seed: VVPCEPPEV (TP53 Y220C)
VYPCEPPEI

SEQ ID NO: 22375 - protein, 9 aa, Artificial Sequence
  Description of Artificial Sequence: Synthetic peptide
  Seed: VVPCEPPEV (TP53 Y220C)
VYPCEPPEK

SEQ ID NO: 22376 - protein, 9 aa, Artificial Sequence
  Description of Artificial Sequence: Synthetic peptide
  Seed: VVPCEPPEV (TP53 Y220C)
VYPCEPPEM

SEQ ID NO: 22377 - protein, 9 aa, Artificial Sequence
  Description of Artificial Sequence: Synthetic peptide
  Seed: VVPCEPPEV (TP53 Y220C)
VYPCEPPEV

SEQ ID NO: 22378 - protein, 9 aa, Artificial Sequence
  Description of Artificial Sequence: Synthetic peptide
  Seed: VVPCEPPEV (TP53 Y220C)
VYPCEPPEY

SEQ ID NO: 22379 - protein, 9 aa, Homo sapiens
  Native (TP53 Y220C)
VVPCEPPEV

SEQ ID NO: 22380 - protein, 10 aa, Homo sapiens
  Native (TP53 Y220C)
VVVPCEPPEV

SEQ ID NO: 22381 - protein, 10 aa, Homo sapiens
  Native (TP53 Y220C)
CEPPEVGSDC

SEQ ID NO: 22382 - protein, 11 aa, Homo sapiens
  Native (TP53 Y220C)
CEPPEVGSDCT

SEQ ID NO: 22383 - protein, 8 aa, Homo sapiens
  Native (TP53 Y220C)
VPCEPPEV

SEQ ID NO: 22384 - protein, 9 aa, Homo sapiens
  Native (TP53 Y220C)
VPCEPPEVG

SEQ ID NO: 22385 - protein, 10 aa, Homo sapiens
  Native (TP53 Y220C)
VPCEPPEVGS

SEQ ID NO: 22386 - protein, 9 aa, Artificial Sequence
  Description of Artificial Sequence: Synthetic peptide
  Seed: GWLHKRGKY (AKT1 E17K)
  misc_feature (2)..(2): Xaa can be Thr, Met, Leu, Ser, Val, Tyr, Ala, Glu, Phe, Gly, Ile, Asn, Gln, or Trp
  misc_feature (9)..(9): Xaa can be Tyr, or Phe
GXLHKRGKX

SEQ ID NO: 22387 - protein, 11 aa, Artificial Sequence
  Description of Artificial Sequence: Synthetic peptide
  Seed: KEGWLHKRGKY (AKT1 E17K)
  misc_feature (2)..(2): Xaa can be , or Glu
  misc_feature (11)..(11): Xaa can be Phe, Leu, Trp, or Tyr
KXGWLHKRGKX

SEQ ID NO: 22388 - protein, 9 aa, Artificial Sequence
  Description of Artificial Sequence: Synthetic peptide
  Seed: KRGKYIKTW (AKT1 E17K)
  misc_feature (2)..(2): Xaa can be Arg, Gln, Thr, Ser, Ala, Phe, Tyr, His, Lys, Val, Glu, Gly, Ile, Leu, Met, Asn, Trp, Cys, Pro, or Asp
  misc_feature (9)..(9): Xaa can be Phe, Trp, Tyr, Leu, Met, Ile, Val, Lys, Cys, Arg, Ala, His, Gln, or Thr
KXGKYIKTX

SEQ ID NO: 22389 - protein, 10 aa, Artificial Sequence
  Description of Artificial Sequence: Synthetic peptide
  Seed: KRGKYIKTWR (AKT1 E17K)
  misc_feature (2)..(2): Xaa can be Arg, Ala, Phe, Ile, Leu, Met, Gln, Ser, Thr, Val, Trp, Tyr, Cys, Asp, Glu, Gly, His, Lys, Asn, or Pro
  misc_feature (10)..(10): Xaa can be Arg, Lys, Phe, Ile, Leu, Met, Tyr, or Trp
KXGKYIKTWX

SEQ ID NO: 22390 - protein, 9 aa, Artificial Sequence
  Description of Artificial Sequence: Synthetic peptide
  Seed: KYIKTWRPR (AKT1 E17K)
  misc_feature (2)..(2): Xaa can be Met, Ser, Thr, Val, Ile, Tyr, Ala, Phe, Leu, Trp, Gln, Gly, Asn, Cys, His, Lys, Arg, Asp, Glu, or Pro
  misc_feature (9)..(9): Xaa can be Arg, Lys, Ala, Ile, Val, Leu, Met, Ser, Gly, Tyr, His, Thr, Pro, Cys, Gln, Phe, Asn, or Gl u
KXIKTWRPX

SEQ ID NO: 22391 - protein, 10 aa, Artificial Sequence
  Description of Artificial Sequence: Synthetic peptide
  Seed: KYIKTWRPRY (AKT1 E17K)
  misc_feature (2)..(2): Xaa can be Phe, Val, Tyr, Met, Ala, Ile, Leu, Gln, Ser, Thr, Trp, Cys, Asp, Glu, Gly, His, Lys, Asn, Arg, or Pro
  misc_feature (10)..(10): Xaa can be Lys, Ala, Ile, Met, Arg, Val, Tyr, Leu, Phe, Cys, Asp, Glu, Gly, His, Asn, Pro, Gln, Ser, Thr, or Trp
KXIKTWRPRX

SEQ ID NO: 22392 - protein, 11 aa, Artificial Sequence
  Description of Artificial Sequence: Synthetic peptide
  Seed: KYIKTWRPRYF (AKT1 E17K)
  misc_feature (2)..(2): Xaa can be Tyr, Trp, or Phe
  misc_feature (11)..(11): Xaa can be Phe, Leu, Trp, Ile, Met, or Val
KXIKTWRPRYX

SEQ ID NO: 22393 - protein, 8 aa, Artificial Sequence
  Description of Artificial Sequence: Synthetic peptide
  Seed: RGKYIKTW (AKT1 E17K)
  misc_feature (2)..(2): Xaa can be Ser, Thr, Ala, Cys, Asp, Glu, Ile, Leu, Met, Asn, Gln, Val, or Gly
  misc_feature (8)..(8): Xaa can be Trp, Phe, Leu, or Tyr
RXKYIKTX

SEQ ID NO: 22394 - protein, 9 aa, Artificial Sequence
  Description of Artificial Sequence: Synthetic peptide
  Seed: RGKYIKTWR (AKT1 E17K)
  misc_feature (2)..(2): Xaa can be Val, Thr, Met, Ser, Ala, Phe, Ile, Tyr, Leu, Gly, Gln, Trp, Asn, Cys, His, Lys, Asp, Glu, or Pro
  misc_feature (9)..(9): Xaa can be Arg, Lys, Ala, Ile, Leu, Met, Ser, Val, Gly, Thr, Tyr, Phe, Asn, Pro, Gln, Cys, Glu, His, or Asp
RXKYIKTWX

SEQ ID NO: 22395 - protein, 11 aa, Artificial Sequence
  Description of Artificial Sequence: Synthetic peptide
  Seed: RGKYIKTWRPR (AKT1 E17K)
  misc_feature (2)..(2): Xaa can be Met, Ala, Cys, Asp, Glu, Phe, Gly, His, Ile, Lys, Leu, Asn, Pro, Gln, Arg, Ser, Thr, Val, Trp, or Tyr
  misc_feature (11)..(11): Xaa can be Lys, Arg, His, or Tyr
RXKYIKTWRPX

SEQ ID NO: 22396 - protein, 9 aa, Artificial Sequence
  Description of Artificial Sequence: Synthetic peptide
  Seed: WLHKRGKYI (AKT1 E17K)
  misc_feature (2)..(2): Xaa can be Met, Leu, Pro, Ala, Ile, Gln, Val, Phe, Gly, Asn, Ser, Lys, Arg, Thr, Cys, Trp, or Tyr
  misc_feature (9)..(9): Xaa can be Leu, Met, Val, Ile, Phe, Ala, Cys, or Thr
WXHKRGKYX

SEQ ID NO: 22397 - protein, 10 aa, Artificial Sequence
  Description of Artificial Sequence: Synthetic peptide
  Seed: DFGLATEKSR (BRAF V600E)
  misc_feature (2)..(2): Xaa can be Tyr, Ala, Gly, Ile, Leu, Met, Gln, Ser, Thr, Val, Trp, or Phe
  misc_feature (10)..(10): Xaa can be Arg, or Lys
DXGLATEKSX

SEQ ID NO: 22398 - protein, 11 aa, Artificial Sequence
  Description of Artificial Sequence: Synthetic peptide
  Seed: EKSRWSGSHQF (BRAF V600E)
  misc_feature (2)..(2): Xaa can be Arg, Phe, Met, Trp, Tyr, Gly, Lys, Ala, Cys, Asp, Glu, His, Ile, Leu, Asn, Pro, Gln, Ser, Thr, or Val
  misc_feature (11)..(11): Xaa can be Phe, Ile, Leu, Met, Val, Lys, Arg, or Tyr
EXSRWSGSHQX

SEQ ID NO: 22399 - protein, 9 aa, Artificial Sequence
  Description of Artificial Sequence: Synthetic peptide
  Seed: FGLATEKSR (BRAF V600E)
  misc_feature (2)..(2): Xaa can be Ala, Ser, Thr, Val, Ile, Gly, Leu, Met, Gln, Cys, Asp, Tyr, Phe, Asn, Pro, or Trp
  misc_feature (9)..(9): Xaa can be Arg, Leu, Met, Lys, Phe, Ile, Val, Tyr, Ala, or Cys
FXLATEKSX

SEQ ID NO: 22400 - protein, 10 aa, Artificial Sequence
  Description of Artificial Sequence: Synthetic peptide
  Seed: FGLATEKSRW (BRAF V600E)
  misc_feature (2)..(2): Xaa can be Ser, Thr, Ala, Cys, Ile, Leu, Met, Asn, Val, Asp, Glu, Phe, Pro, Gln, or Gly
  misc_feature (10)..(10): Xaa can be Trp, or Phe
FXLATEKSRX

SEQ ID NO: 22401 - protein, 9 aa, Artificial Sequence
  Description of Artificial Sequence: Synthetic peptide
  Seed: GDFGLATEK (BRAF V600E)
  misc_feature (2)..(2): Xaa can be Ala, Glu, Gln, Ile, Ser, Thr, Val, Asp, Cys, Leu, Met, Gly, Asn, Arg, Pro, Lys, Phe, His, Trp, or Tyr
  misc_feature (9)..(9): Xaa can be Lys, Leu, Phe, Tyr, Met, Arg, His, Ile, Val, Trp, Ala, or Cys
GXFGLATEX

SEQ ID NO: 22402 - protein, 9 aa, Artificial Sequence
  Description of Artificial Sequence: Synthetic peptide
  Seed: GLATEKSRW (BRAF V600E)
  misc_feature (2)..(2): Xaa can be Gln, Leu, Met, Ile, Val, Ser, Ala, Thr, Cys, Glu, Gly, Asn, or Pro
  misc_feature (9)..(9): Xaa can be Trp, Phe, Leu, Ile, Met, Val, or Tyr
GXATEKSRX

SEQ ID NO: 22403 - protein, 10 aa, Artificial Sequence
  Description of Artificial Sequence: Synthetic peptide
  Seed: IGDFGLATEK (BRAF V600E)
  misc_feature (2)..(2): Xaa can be Ser, Thr, Ala, Ile, Leu, Met, Val, Phe, Tyr, Gly, Trp, Cys, Gln, Asp, Glu, Asn, His, Pro, Lys, or Arg
  misc_feature (10)..(10): Xaa can be Tyr, Lys, Arg, Phe, Leu, Met, Trp, His, Ile, Val, or Gln
IXDFGLATEX

SEQ ID NO: 22404 - protein, 11 aa, Artificial Sequence
  Description of Artificial Sequence: Synthetic peptide
  Seed: KIGDFGLATEK (BRAF V600E)
  misc_feature (2)..(2): Xaa can be Ala, Thr, Ser, Val, Met, Gly, Ile, Leu, Gln, Cys, Glu, Phe, Asn, Tyr, Pro, Trp, or Asp
  misc_feature (11)..(11): Xaa can be Lys, Arg, Tyr, Phe, Met, Leu, Trp, His, Ile, Val, Ala, Cys, or Gln
KXGDFGLATEX

SEQ ID NO: 22405 - protein, 8 aa, Artificial Sequence
  Description of Artificial Sequence: Synthetic peptide
  Seed: LATEKSRW (BRAF V600E)
  misc_feature (2)..(2): Xaa can be Cys, Asp, Gly, Ile, Leu, Met, Asn, Ser, Thr, Val, or Ala
  misc_feature (8)..(8): Xaa can be , or Trp
LXTEKSRX

SEQ ID NO: 22406 - protein, 9 aa, Artificial Sequence
  Description of Artificial Sequence: Synthetic peptide
  Seed: ATMKSRWSG (BRAF V600M)
  misc_feature (2)..(2): Xaa can be Thr, Ser, Ala, Val, Met, Ile, Tyr, Phe, Gln, Gly, Leu, Trp, Asn, Cys, His, Lys, or Arg
  misc_feature (9)..(9): Xaa can be Lys, Ala, Val, Ile, Arg, Met, Ser, Gly, Leu, Tyr, Thr, Cys, Phe, His, Asn, Pro, Gln, or Gl u
AXMKSRWSX

SEQ ID NO: 22407 - protein, 10 aa, Artificial Sequence
  Description of Artificial Sequence: Synthetic peptide
  Seed: ATMKSRWSGS (BRAF V600M)
  misc_feature (2)..(2): Xaa can be Thr, Ser, Tyr, Ala, Val, Phe, Ile, Met, Arg, Trp, Gly, Lys, Gln, Cys, Leu, Asn, Asp, Glu, His, or Pro
  misc_feature (10)..(10): Xaa can be Lys, Ala, Val, Ile, Met, Leu, Arg, Ser, Thr, Tyr, Phe, or Gly
AXMKSRWSGX

SEQ ID NO: 22408 - protein, 10 aa, Artificial Sequence
  Description of Artificial Sequence: Synthetic peptide
  Seed: DFGLATMKSR (BRAF V600M)
  misc_feature (2)..(2): Xaa can be Tyr, Phe, Ile, Met, Ser, Thr, Val, Trp, Ala, Gly, Leu, Asn, or Gln
  misc_feature (10)..(10): Xaa can be Arg, or Lys
DXGLATMKSX

SEQ ID NO: 22409 - protein, 9 aa, Artificial Sequence
  Description of Artificial Sequence: Synthetic peptide
  Seed: FGLATMKSR (BRAF V600M)
  misc_feature (2)..(2): Xaa can be Met, Leu, Thr, Val, Ile, Ala, Phe, Asn, Gln, Ser, Tyr, Asp, Gly, Pro, Trp, Cys, Glu, or Hi s
  misc_feature (9)..(9): Xaa can be Arg, Lys, Leu, Tyr, Val, Met, Ile, His, or Phe
FXLATMKSX

SEQ ID NO: 22410 - protein, 10 aa, Artificial Sequence
  Description of Artificial Sequence: Synthetic peptide
  Seed: FGLATMKSRW (BRAF V600M)
  misc_feature (2)..(2): Xaa can be Thr, Ser, Ala, Val, Cys, Ile, Leu, Met, Asn, Gln, Asp, Pro, or Gly
  misc_feature (10)..(10): Xaa can be Trp, Phe, Tyr, Ile, Leu, or Met
FXLATMKSRX

SEQ ID NO: 22411 - protein, 9 aa, Artificial Sequence
  Description of Artificial Sequence: Synthetic peptide
  Seed: GDFGLATMK (BRAF V600M)
  misc_feature (2)..(2): Xaa can be Ala, Ile, Ser, Thr, Val, Met, Asp, Gly, Leu, Asn, Pro, Gln, Cys, Glu, Phe, or Tyr
  misc_feature (9)..(9): Xaa can be Lys, Arg, Tyr, or His
GXFGLATMX

SEQ ID NO: 22412 - protein, 9 aa, Artificial Sequence
  Description of Artificial Sequence: Synthetic peptide
  Seed: GLATMKSRW (BRAF V600M)
  misc_feature (2)..(2): Xaa can be Gln, Met, Leu, Ser, Thr, Ala, Ile, Val, Cys, Asp, Glu, Gly, Asn, or Pro
  misc_feature (9)..(9): Xaa can be Trp, Phe, Leu, Ile, Tyr, Met, or Val
GXATMKSRX

SEQ ID NO: 22413 - protein, 10 aa, Artificial Sequence
  Description of Artificial Sequence: Synthetic peptide
  Seed: IGDFGLATMK (BRAF V600M)
  misc_feature (2)..(2): Xaa can be Thr, Ser, Val, Ala, Met, Ile, Leu, Phe, Gly, Glu, Asn, Gln, Tyr, Cys, Asp, Trp, His, Lys, or Pro
  misc_feature (10)..(10): Xaa can be Tyr, Lys, Arg, Phe, His, Trp, Met, Leu, Gln, or Val
IXDFGLATMX

SEQ ID NO: 22414 - protein, 11 aa, Artificial Sequence
  Description of Artificial Sequence: Synthetic peptide
  Seed: KIGDFGLATMK (BRAF V600M)
  misc_feature (2)..(2): Xaa can be Thr, Ala, Ser, Val, Met, Gly, Ile, Leu, Cys, Phe, Asn, Gln, Asp, Glu, Tyr, Trp, or Pro
  misc_feature (11)..(11): Xaa can be Lys, Arg, Tyr, Phe, Leu, Met, Trp, Ile, His, or Val
KXGDFGLATMX

SEQ ID NO: 22415 - protein, 8 aa, Artificial Sequence
  Description of Artificial Sequence: Synthetic peptide
  Seed: LATMKSRW (BRAF V600M)
  misc_feature (2)..(2): Xaa can be Cys, Gly, Ser, Thr, Val, or Ala
  misc_feature (8)..(8): Xaa can be , or Trp
LXTMKSRX

SEQ ID NO: 22416 - protein, 9 aa, Artificial Sequence
  Description of Artificial Sequence: Synthetic peptide
  Seed: MKSRWSGSH (BRAF V600M)
  misc_feature (2)..(2): Xaa can be Gln, Lys, Met, Ala, Glu, His, Leu, Arg, Ile, Ser, Val, Phe, Gly, Asn, Thr, Tyr, Cys, Pro, or Trp
  misc_feature (9)..(9): Xaa can be Phe, Tyr, Met, Leu, Ile, Trp, His, Ala, Val, Cys, Gly, Gln, Ser, or Thr
MXSRWSGSX

SEQ ID NO: 22417 - protein, 11 aa, Artificial Sequence
  Description of Artificial Sequence: Synthetic peptide
  Seed: MKSRWSGSHQF (BRAF V600M)
  misc_feature (2)..(2): Xaa can be Arg, Met, Gln, Ala, Cys, Asp, Glu, Phe, Gly, His, Ile, Lys, Leu, Asn, Pro, Ser, Thr, Val, Trp, or Tyr
  misc_feature (11)..(11): Xaa can be Phe, Ala, His, Ile, Lys, Leu, Met, Arg, Val, Trp, Tyr, or Cys
MXSRWSGSHQX

SEQ ID NO: 22418 - protein, 8 aa, Artificial Sequence
  Description of Artificial Sequence: Synthetic peptide
  Seed: FGVTCVKK (EGFR A289V)
  misc_feature (2)..(2): Xaa can be Ala, Ser, Gly, Ile, Thr, Val, Asp, Asn, or Gln
  misc_feature (8)..(8): Xaa can be Lys, Leu, Met, Phe, Ile, Arg, Val, or Tyr
FXVTCVKX

SEQ ID NO: 22419 - protein, 11 aa, Artificial Sequence
  Description of Artificial Sequence: Synthetic peptide
  Seed: FGVTCVKKCPR (EGFR A289V)
  misc_feature (2)..(2): Xaa can be Phe, Met, Tyr, Ala, Cys, Asp, Glu, His, Ile, Lys, Leu, Asn, Pro, Gln, Arg, Ser, Thr, Val, Trp, or Gly
  misc_feature (11)..(11): Xaa can be Arg, or Lys
FXVTCVKKCPX

SEQ ID NO: 22420 - protein, 9 aa, Artificial Sequence
  Description of Artificial Sequence: Synthetic peptide
  Seed: GKYSFGVTC (EGFR A289V)
  misc_feature (2)..(2): Xaa can be Gln, Arg, His, Glu, Lys, Ala, Pro, Met, Asn, Asp, Gly, Leu, Ile, Ser, Thr, Val, Cys, Phe, Trp, or Tyr
  misc_feature (9)..(9): Xaa can be Phe, Tyr, Leu, Met, Ala, Ile, Val, Trp, His, Cys, Thr, Gly, Pro, Ser, Lys, Arg, Asn, or Gl n
GXYSFGVTX

SEQ ID NO: 22421 - protein, 11 aa, Artificial Sequence
  Description of Artificial Sequence: Synthetic peptide
  Seed: GKYSFGVTCVK (EGFR A289V)
  misc_feature (2)..(2): Xaa can be Thr, Ala, Cys, Asp, Glu, Phe, Gly, His, Ile, Lys, Leu, Met, Asn, Pro, Gln, Arg, Ser, Val, Trp, or Tyr
  misc_feature (11)..(11): Xaa can be Lys, Arg, or Tyr
GXYSFGVTCVX

SEQ ID NO: 22422 - protein, 9 aa, Artificial Sequence
  Description of Artificial Sequence: Synthetic peptide
  Seed: KYSFGVTCV (EGFR A289V)
  misc_feature (2)..(2): Xaa can be Tyr, Phe, Trp, Arg, Ala, His, Gln, Met, Lys, or Leu
  misc_feature (9)..(9): Xaa can be Phe, Leu, Met, Tyr, Ile, Val, Trp, Cys, or His
KXSFGVTCX

SEQ ID NO: 22423 - protein, 10 aa, Artificial Sequence
  Description of Artificial Sequence: Synthetic peptide
  Seed: KYSFGVTCVK (EGFR A289V)
  misc_feature (2)..(2): Xaa can be Thr, Met, Phe, Ser, Val, Trp, Ile, Leu, Tyr, Ala, Gly, Asn, Gln, Cys, Asp, Glu, His, Lys, Pro, or Arg
  misc_feature (10)..(10): Xaa can be Lys, Ala, Arg, Val, Tyr, Ile, His, Leu, Met, or Ser
KXSFGVTCVX

SEQ ID NO: 22424 - protein, 11 aa, Artificial Sequence
  Description of Artificial Sequence: Synthetic peptide
  Seed: KYSFGVTCVKK (EGFR A289V)
  misc_feature (2)..(2): Xaa can be Asp, Glu, Phe, Ile, Met, Ser, Thr, Val, Trp, Tyr, Ala, Cys, Gly, His, Lys, Leu, Asn, Pro, Gln, or Arg
  misc_feature (11)..(11): Xaa can be Arg, or Lys
KXSFGVTCVKX

SEQ ID NO: 22425 - protein, 9 aa, Artificial Sequence
  Description of Artificial Sequence: Synthetic peptide
  Seed: SFGVTCVKK (EGFR A289V)
  misc_feature (2)..(2): Xaa can be Thr, Val, Ala, Phe, Gly, Ile, Leu, Met, Gln, Ser, Tyr, Trp, Asp, Asn, or Pro
  misc_feature (9)..(9): Xaa can be Lys, Arg, His, or Tyr
SXGVTCVKX

SEQ ID NO: 22426 - protein, 9 aa, Artificial Sequence
  Description of Artificial Sequence: Synthetic peptide
  Seed: VTCVKKCPR (EGFR A289V)
  misc_feature (2)..(2): Xaa can be Thr, Val, Ala, Phe, Gly, Ile, Leu, Met, Gln, Ser, Trp, Tyr, Asp, Asn, Cys, Glu, His, or Pr o
  misc_feature (9)..(9): Xaa can be Arg, Lys, or Tyr
VXCVKKCPX

SEQ ID NO: 22427 - protein, 11 aa, Artificial Sequence
  Description of Artificial Sequence: Synthetic peptide
  Seed: VTCVKKCPRNY (EGFR A289V)
  misc_feature (2)..(2): Xaa can be Ser, Thr, Ala, Met, Cys, Asp, Glu, Gly, Ile, Leu, Asn, Pro, Gln, or Val
  misc_feature (11)..(11): Xaa can be Trp, Phe, or Tyr
VXCVKKCPRNX

SEQ ID NO: 22428 - protein, 8 aa, Artificial Sequence
  Description of Artificial Sequence: Synthetic peptide
  Seed: YSFGVTCV (EGFR A289V)
  misc_feature (2)..(2): Xaa can be Ala, Ser, Thr, Gly, Ile, Met, Gln, Val, Glu, Asp, Asn, Pro, or Leu
  misc_feature (8)..(8): Xaa can be Ile, Leu, Val, Met, Phe, Tyr, or His
YXFGVTCX

SEQ ID NO: 22429 - protein, 9 aa, Artificial Sequence
  Description of Artificial Sequence: Synthetic peptide
  Seed: YSFGVTCVK (EGFR A289V)
  misc_feature (2)..(2): Xaa can be Ala, Ser, Thr, Val, Met, Ile, Leu, Gly, Gln, Cys, Asn, Phe, Pro, Tyr, His, Lys, Arg, Glu, Asp, or Trp
  misc_feature (9)..(9): Xaa can be Arg, Met, Tyr, Phe, Leu, Lys, Ile, Val, His, Trp, Ala, Cys, Thr, Gln, Ser, Gly, Asn, Glu, or Pro
YXFGVTCVX

SEQ ID NO: 22430 - protein, 10 aa, Artificial Sequence
  Description of Artificial Sequence: Synthetic peptide
  Seed: YSFGVTCVKK (EGFR A289V)
  misc_feature (2)..(2): Xaa can be Ala, Ile, Ser, Thr, Val, Leu, Met, Cys, Asp, Glu, Phe, Gly, Asn, Gln, Pro, Trp, Tyr, His, Lys, or Arg
  misc_feature (10)..(10): Xaa can be Arg, Lys, Tyr, Ala, Phe, Ile, Leu, Met, Val, Cys, Asp, Glu, Gly, His, Asn, Pro, Gln, Ser, Thr, or Trp
YXFGVTCVKX

SEQ ID NO: 22431 - protein, 9 aa, Artificial Sequence
  Description of Artificial Sequence: Synthetic peptide
  Seed: CVKTCPAVV (EGFR G598V)
  misc_feature (2)..(2): Xaa can be Ala, Pro, Leu, Met, Ser, Val, Ile, Gln, Thr, Glu, Gly, Cys, Phe, Asn, Asp, or Tyr
  misc_feature (9)..(9): Xaa can be Tyr, Phe, Met, Leu, Val, Ile, His, Ala, Thr, Cys, Trp, Lys, Pro, or Ser
CXKTCPAVX

SEQ ID NO: 22432 - protein, 10 aa, Artificial Sequence
  Description of Artificial Sequence: Synthetic peptide
  Seed: CVKTCPAVVM (EGFR G598V)
  misc_feature (2)..(2): Xaa can be Ala, Ser, Thr, Val, Ile, Met, Gly, Leu, or Gln
  misc_feature (10)..(10): Xaa can be Tyr, Phe, Met, Leu, or His
CXKTCPAVVX

SEQ ID NO: 22433 - protein, 8 aa, Artificial Sequence
  Description of Artificial Sequence: Synthetic peptide
  Seed: KTCPAVVM (EGFR G598V)
  misc_feature (2)..(2): Xaa can be Ala, Ser, Val, Ile, Thr, Gly, Met, Cys, Leu, Asn, Gln, Asp, or Pro
  misc_feature (8)..(8): Xaa can be Trp, Leu, Tyr, Phe, Met, Ile, Val, His, Ala, or Lys
KXCPAVVX

SEQ ID NO: 22434 - protein, 9 aa, Artificial Sequence
  Description of Artificial Sequence: Synthetic peptide
  Seed: VKTCPAVVM (EGFR G598V)
  misc_feature (2)..(2): Xaa can be Gln, Met, Lys, His, Arg, Ser, Ala, Glu, Ile, Leu, Thr, Val, Phe, Gly, Asn, Tyr, or Pro
  misc_feature (9)..(9): Xaa can be Tyr, Phe, Met, Leu, Ile, Trp, His, Val, or Ala
VXTCPAVVX

SEQ ID NO: 22435 - protein, 9 aa, Artificial Sequence
  Description of Artificial Sequence: Synthetic peptide
  Seed: VVMGENNTL (EGFR G598V)
  misc_feature (2)..(2): Xaa can be Ala, Pro, Met, Leu, Gln, Ser, Arg, Thr, Ile, Val, Gly, Asp, Glu, Phe, Asn, Tyr, Cys, Trp, His, or Lys
  misc_feature (9)..(9): Xaa can be Met, Leu, Phe, Tyr, Trp, Val, Ile, Lys, Arg, Ala, His, Cys, Thr, Gln, Pro, or Ser
VXMGENNTX

SEQ ID NO: 22436 - protein, 10 aa, Artificial Sequence
  Description of Artificial Sequence: Synthetic peptide
  Seed: VVMGENNTLV (EGFR G598V)
  misc_feature (2)..(2): Xaa can be Leu, Gln, Met, Ile, Val, Phe, Thr, Ala, Tyr, Glu, Ser, Trp, Cys, Asp, Gly, His, Lys, Asn, Pro, or Arg
  misc_feature (10)..(10): Xaa can be Val, Leu, Ile, Ala, Met, Thr, Cys, Phe, Trp, Tyr, Asp, Glu, Gly, His, Lys, Asn, Pro, Gln, Arg, or Ser
VXMGENNTLX

SEQ ID NO: 22437 - protein, 11 aa, Artificial Sequence
  Description of Artificial Sequence: Synthetic peptide
  Seed: VVMGENNTLVW (EGFR G598V)
  misc_feature (2)..(2): Xaa can be Ala, Ser, Thr, Gln, Met, Ile, Leu, Val, Gly, Pro, Glu, Cys, Asn, Asp, Phe, Lys, His, Arg, Trp, or Tyr
  misc_feature (11)..(11): Xaa can be Trp, Tyr, Phe, Lys, Leu, Met, Ile, Arg, His, Val, Cys, Ala, or Gln
VXMGENNTLVX

SEQ ID NO: 22438 - protein, 9 aa, Artificial Sequence
  Description of Artificial Sequence: Synthetic peptide
  Seed: FGRAKLLGA (EGFR L858R)
  misc_feature (2)..(2): Xaa can be Pro, Met, Ser, Thr, Leu, Ala, Ile, Val, Gln, Phe, Gly, Asn, Tyr, Cys, Glu, His, Lys, Arg, Trp, or Asp
  misc_feature (9)..(9): Xaa can be Leu, Ile, Met, Val, Phe, Lys, Ala, Cys, Thr, Gly, Ser, Tyr, Glu, Pro, Arg, Trp, Asp, His, Asn, or Gln
FXRAKLLGX

SEQ ID NO: 22439 - protein, 11 aa, Artificial Sequence
  Description of Artificial Sequence: Synthetic peptide
  Seed: HVKITDFGRAK (EGFR L858R)
  misc_feature (2)..(2): Xaa can be Met, Ser, Thr, Tyr, Ala, Ile, Leu, Val, Phe, Gly, Asn, Gln, or Trp
  misc_feature (11)..(11): Xaa can be Arg, or Lys
HXKITDFGRAX

SEQ ID NO: 22440 - protein, 8 aa, Artificial Sequence
  Description of Artificial Sequence: Synthetic peptide
  Seed: ITDFGRAK (EGFR L858R)
  misc_feature (2)..(2): Xaa can be Thr, Ser, Ala, Ile, Val, Gly, Leu, Met, Cys, Asp, Glu, Phe, Asn, or Gln
  misc_feature (8)..(8): Xaa can be Tyr, Lys, Phe, Arg, Leu, Met, His, or Trp
IXDFGRAX

SEQ ID NO: 22441 - protein, 9 aa, Artificial Sequence
  Description of Artificial Sequence: Synthetic peptide
  Seed: ITDFGRAKL (EGFR L858R)
  misc_feature (2)..(2): Xaa can be Ser, Ala, Thr, Ile, Leu, Met, Val, Gly, Glu, Phe, Tyr, Gln, Trp, Asp, Asn, Cys, Arg, His, Pro, or Lys
  misc_feature (9)..(9): Xaa can be Met, Leu, Trp, Tyr, Phe, Ile, Val, Lys, Cys, Ala, Arg, His, Thr, or Gln
IXDFGRAKX

SEQ ID NO: 22442 - protein, 10 aa, Artificial Sequence
  Description of Artificial Sequence: Synthetic peptide
  Seed: ITDFGRAKLL (EGFR L858R)
  misc_feature (2)..(2): Xaa can be Thr, Ala, Met, Ser, Val, Ile, Phe, Leu, Gly, Tyr, Cys, Gln, Trp, Asn, Pro, Asp, His, Glu, or Lys
  misc_feature (10)..(10): Xaa can be Tyr, Trp, Phe, Leu, Met, Ile, Lys, Val, Arg, His, Cys, or Gln
IXDFGRAKLX

SEQ ID NO: 22443 - protein, 9 aa, Artificial Sequence
  Description of Artificial Sequence: Synthetic peptide
  Seed: KITDFGRAK (EGFR L858R)
  misc_feature (2)..(2): Xaa can be Ala, Thr, Ser, Val, Met, Leu, Phe, Gly, Ile, Gln, Asn, Cys, Trp, Tyr, Pro, Asp, or Glu
  misc_feature (9)..(9): Xaa can be Tyr, Phe, Lys, Arg, Leu, Met, Val, Ile, Trp, His, Ala, Cys, or Thr
KXTDFGRAX

SEQ ID NO: 22444 - protein, 10 aa, Artificial Sequence
  Description of Artificial Sequence: Synthetic peptide
  Seed: KITDFGRAKL (EGFR L858R)
  misc_feature (2)..(2): Xaa can be Gln, Leu, Ala, Ile, Met, Val, Ser, Thr, Glu, Gly, Asn, Phe, Trp, Tyr, Cys, or Lys
  misc_feature (10)..(10): Xaa can be Trp, Arg, Lys, Tyr, Phe, Val, Ile, Leu, Met, Ala, His, or Cys
KXTDFGRAKX

SEQ ID NO: 22445 - protein, 11 aa, Artificial Sequence
  Description of Artificial Sequence: Synthetic peptide
  Seed: QHVKITDFGRA (EGFR L858R)
  misc_feature (2)..(2): Xaa can be , or His
  misc_feature (11)..(11): Xaa can be , or Ala
QXVKITDFGRX

SEQ ID NO: 22446 - protein, 10 aa, Artificial Sequence
  Description of Artificial Sequence: Synthetic peptide
  Seed: RAKLLGAEEK (EGFR L858R)
  misc_feature (2)..(2): Xaa can be Thr, Ser, Val, Ala, Ile, Met, Tyr, Phe, Leu, Gln, Gly, or Trp
  misc_feature (10)..(10): Xaa can be Lys, Ala, Arg, Val, Ile, Leu, Met, Ser, Gly, Thr, or Tyr
RXKLLGAEEX

SEQ ID NO: 22447 - protein, 8 aa, Artificial Sequence
  Description of Artificial Sequence: Synthetic peptide
  Seed: TDFGRAKL (EGFR L858R)
  misc_feature (2)..(2): Xaa can be Glu, Asp, His, Gln, Arg, Ala, Phe, Lys, Asn, Pro, Ser, or Tyr
  misc_feature (8)..(8): Xaa can be Leu, Ile, Met, Val, Phe, Tyr, Ala, Cys, or Thr
TXFGRAKX

SEQ ID NO: 22448 - protein, 9 aa, Artificial Sequence
  Description of Artificial Sequence: Synthetic peptide
  Seed: TDFGRAKLL (EGFR L858R)
  misc_feature (2)..(2): Xaa can be Glu, Gln, Asp, His, Arg, Ala, Phe, Gly, Ile, Leu, Met, Asn, Pro, Ser, Thr, Val, Tyr, Lys, Trp, or Cys
  misc_feature (9)..(9): Xaa can be Leu, Met, Val, Ile, Phe, Cys, Ala, Thr, Trp, Tyr, Pro, Lys, Asp, Glu, Gly, Gln, Arg, or Se r
TXFGRAKLX

SEQ ID NO: 22449 - protein, 10 aa, Artificial Sequence
  Description of Artificial Sequence: Synthetic peptide
  Seed: VKITDFGRAK (EGFR L858R)
  misc_feature (2)..(2): Xaa can be Thr, Val, Ile, Leu, Met, Ala, Cys, Asp, Glu, Phe, Gly, His, Asn, Pro, Gln, Arg, Ser, Trp, Tyr, or Lys
  misc_feature (10)..(10): Xaa can be Lys, Arg, or Tyr
VXITDFGRAX

SEQ ID NO: 22450 - protein, 9 aa, Artificial Sequence
  Description of Artificial Sequence: Synthetic peptide
  Seed: ERILHAKER (GTF2I L424H)
  misc_feature (2)..(2): Xaa can be , or Arg
  misc_feature (9)..(9): Xaa can be Phe, His, Ile, Lys, Leu, Met, Val, Trp, Tyr, or Arg
EXILHAKEX

SEQ ID NO: 22451 - protein, 10 aa, Artificial Sequence
  Description of Artificial Sequence: Synthetic peptide
  Seed: ERILHAKERI (GTF2I L424H)
  misc_feature (2)..(2): Xaa can be , or Arg
  misc_feature (10)..(10): Xaa can be Phe, Leu, Met, or Ile
EXILHAKERX

SEQ ID NO: 22452 - protein, 8 aa, Artificial Sequence
  Description of Artificial Sequence: Synthetic peptide
  Seed: HAKERIRF (GTF2I L424H)
  misc_feature (2)..(2): Xaa can be Leu, Met, Pro, Ala, Ile, Gln, Ser, Thr, Val, Phe, Gly, Arg, Asn, Tyr, Asp, Glu, His, Cys, Lys, or Trp
  misc_feature (8)..(8): Xaa can be Leu, Met, Ile, Phe, Val, Tyr, Ala, or Cys
HXKERIRX

SEQ ID NO: 22453 - protein, 9 aa, Artificial Sequence
  Description of Artificial Sequence: Synthetic peptide
  Seed: HAKERIRFV (GTF2I L424H)
  misc_feature (2)..(2): Xaa can be Thr, Ser, Met, Val, Tyr, Pro, Ile, Ala, Arg, Phe, Leu, Gln, Gly, Asn, Trp, Cys, His, Glu, Lys, or Asp
  misc_feature (9)..(9): Xaa can be Leu, Met, Val, Phe, Ile, Tyr, Lys, Ala, Cys, Trp, Ser, His, Gly, Thr, Arg, Pro, Asn, Gln, or Glu
HXKERIRFX

SEQ ID NO: 22454 - protein, 10 aa, Artificial Sequence
  Description of Artificial Sequence: Synthetic peptide
  Seed: HAKERIRFVI (GTF2I L424H)
  misc_feature (2)..(2): Xaa can be Met, Leu, Ala, Ile, Pro, Gln, Val, Phe, Gly, Lys, Asn, Arg, Ser, Thr, Cys, or Trp
  misc_feature (10)..(10): Xaa can be Leu, Met, Ile, Ala, Phe, Val, Cys, or Thr
HXKERIRFVX

SEQ ID NO: 22455 - protein, 11 aa, Artificial Sequence
  Description of Artificial Sequence: Synthetic peptide
  Seed: HAKERIRFVIK (GTF2I L424H)
  misc_feature (2)..(2): Xaa can be Ser, Thr, Phe, Gly, Ile, Met, Gln, Val, Tyr, or Ala
  misc_feature (11)..(11): Xaa can be Lys, Ala, or Val
HXKERIRFVIX

SEQ ID NO: 22456 - protein, 9 aa, Artificial Sequence
  Description of Artificial Sequence: Synthetic peptide
  Seed: ILHAKERIR (GTF2I L424H)
  misc_feature (2)..(2): Xaa can be Ile, Met, Thr, Val, Leu, Phe, Ser, Tyr, Ala, Asp, Gly, Asn, Pro, Gln, or Trp
  misc_feature (9)..(9): Xaa can be Arg, or Lys
IXHAKERIX

SEQ ID NO: 22457 - protein, 11 aa, Artificial Sequence
  Description of Artificial Sequence: Synthetic peptide
  Seed: ILHAKERIRFV (GTF2I L424H)
  misc_feature (2)..(2): Xaa can be Met, or Leu
  misc_feature (11)..(11): Xaa can be , or Val
IXHAKERIRFX

SEQ ID NO: 22458 - protein, 10 aa, Artificial Sequence
  Description of Artificial Sequence: Synthetic peptide
  Seed: IPRLERILHA (GTF2I L424H)
  misc_feature (2)..(2): Xaa can be , or Pro
  misc_feature (10)..(10): Xaa can be Met, Leu, Phe, Ile, Val, Cys, Pro, Ser, Thr, or Ala
IXRLERILHX

SEQ ID NO: 22459 - protein, 9 aa, Artificial Sequence
  Description of Artificial Sequence: Synthetic peptide
  Seed: PRLERILHA (GTF2I L424H)
  misc_feature (2)..(2): Xaa can be His, Gln, or Arg
  misc_feature (9)..(9): Xaa can be Ala, Val, Ile, or Leu
PXLERILHX

SEQ ID NO: 22460 - protein, 10 aa, Artificial Sequence
  Description of Artificial Sequence: Synthetic peptide
  Seed: PRLERILHAK (GTF2I L424H)
  misc_feature (2)..(2): Xaa can be Met, or Arg
  misc_feature (10)..(10): Xaa can be , or Lys
PXLERILHAX

SEQ ID NO: 22461 - protein, 8 aa, Artificial Sequence
  Description of Artificial Sequence: Synthetic peptide
  Seed: RILHAKER (GTF2I L424H)
  misc_feature (2)..(2): Xaa can be Phe, Leu, Met, Thr, Val, or Ile
  misc_feature (8)..(8): Xaa can be , or Arg
RXLHAKEX

SEQ ID NO: 22462 - protein, 9 aa, Artificial Sequence
  Description of Artificial Sequence: Synthetic peptide
  Seed: RILHAKERI (GTF2I L424H)
  misc_feature (2)..(2): Xaa can be Gln, Met, Thr, Ala, Ile, Leu, Ser, Val, Glu, Asn, Asp, Gly, Cys, or Phe
  misc_feature (9)..(9): Xaa can be Trp, Val, Phe, Leu, Ile, Tyr, Met, Ala, Cys, or Thr
RXLHAKERX

SEQ ID NO: 22463 - protein, 10 aa, Artificial Sequence
  Description of Artificial Sequence: Synthetic peptide
  Seed: RILHAKERIR (GTF2I L424H)
  misc_feature (2)..(2): Xaa can be Ala, Phe, Ile, Leu, Met, Ser, Thr, Val, Trp, Tyr, Cys, Gly, His, Asn, or Gln
  misc_feature (10)..(10): Xaa can be Arg, or Lys
RXLHAKERIX

SEQ ID NO: 22464 - protein, 11 aa, Artificial Sequence
  Description of Artificial Sequence: Synthetic peptide
  Seed: RILHAKERIRF (GTF2I L424H)
  misc_feature (2)..(2): Xaa can be Thr, Val, Met, Ile, Leu, Ser, Ala, Gln, Tyr, Phe, Gly, Asn, Trp, Cys, or Glu
  misc_feature (11)..(11): Xaa can be Tyr, Phe, Trp, Leu, Met, or Ile
RXLHAKERIRX

SEQ ID NO: 22465 - protein, 9 aa, Artificial Sequence
  Description of Artificial Sequence: Synthetic peptide
  Seed: RLERILHAK (GTF2I L424H)
  misc_feature (2)..(2): Xaa can be Met, Leu, Thr, Val, Ile, Ser, Ala, Phe, Gly, Asn, Gln, Trp, Tyr, Cys, or Glu
  misc_feature (9)..(9): Xaa can be Arg, Lys, Leu, Tyr, Ala, Ile, Val, Phe, Met, or His
RXERILHAX

SEQ ID NO: 22466 - protein, 11 aa, Artificial Sequence
  Description of Artificial Sequence: Synthetic peptide
  Seed: RLERILHAKER (GTF2I L424H)
  misc_feature (2)..(2): Xaa can be Arg, Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Phe, Lys, Leu, Met, Arg, Ile, or Tyr
RXERILHAKEX

SEQ ID NO: 22467 - protein, 10 aa, Artificial Sequence
  Description of Artificial Sequence: Synthetic peptide
  Seed: CHAYGDQYRA (IDH1 R132C)
  misc_feature (2)..(2): Xaa can be , or His
  misc_feature (10)..(10): Xaa can be , or Ala
CXAYGDQYRX

SEQ ID NO: 22468 - protein, 10 aa, Artificial Sequence
  Description of Artificial Sequence: Synthetic peptide
  Seed: IGCHAYGDQY (IDH1 R132C)
  misc_feature (2)..(2): Xaa can be Ala, Ile, Leu, Met, Ser, Thr, Val, Gly, Phe, Asn, Gln, Trp, Tyr, Cys, Asp, or Glu
  misc_feature (10)..(10): Xaa can be Tyr, or Lys
IXCHAYGDQX

SEQ ID NO: 22469 - protein, 11 aa, Artificial Sequence
  Description of Artificial Sequence: Synthetic peptide
  Seed: IGCHAYGDQYR (IDH1 R132C)
  misc_feature (2)..(2): Xaa can be Phe, Leu, Met, Thr, Val, Trp, Tyr, Ala, Ile, Asn, Gln, Ser, or Gly
  misc_feature (11)..(11): Xaa can be Arg, or Lys
IXCHAYGDQYX

SEQ ID NO: 22470 - protein, 11 aa, Artificial Sequence
  Description of Artificial Sequence: Synthetic peptide
  Seed: IIGCHAYGDQY (IDH1 R132C)
  misc_feature (2)..(2): Xaa can be Ala, Leu, Met, Ser, Thr, Val, or Ile
  misc_feature (11)..(11): Xaa can be , or Tyr
IXGCHAYGDQX

SEQ ID NO: 22471 - protein, 8 aa, Artificial Sequence
  Description of Artificial Sequence: Synthetic peptide
  Seed: IIIGCHAY (IDH1 R132C)
  misc_feature (2)..(2): Xaa can be Ala, Met, Gln, Ser, Thr, Val, Leu, Asp, Glu, Gly, Ile, Pro, Phe, His, Lys, Asn, Arg, Trp, or Tyr
  misc_feature (8)..(8): Xaa can be Tyr, Phe, Leu, Met, His, Ile, or Val
IXIGCHAX

SEQ ID NO: 22472 - protein, 9 aa, Artificial Sequence
  Description of Artificial Sequence: Synthetic peptide
  Seed: KPIIIGCHA (IDH1 R132C)
  misc_feature (2)..(2): Xaa can be , or Pro
  misc_feature (9)..(9): Xaa can be Leu, Ala, Phe, Ile, Met, Val, Cys, Gly, Pro, Ser, Thr, or Tyr
KXIIIGCHX

SEQ ID NO: 22473 - protein, 10 aa, Artificial Sequence
  Description of Artificial Sequence: Synthetic peptide
  Seed: KPIIIGCHAY (IDH1 R132C)
  misc_feature (2)..(2): Xaa can be Pro, Gln, Met, Ala, Leu, Ile, Ser, Thr, Val, Cys, Asp, Glu, Phe, Gly, His, Lys, Asn, Arg, Trp, or Tyr
  misc_feature (10)..(10): Xaa can be Tyr, Phe, Met, Leu, Trp, Ile, His, Val, Ala, Cys, Gly, Pro, Ser, or Thr
KXIIIGCHAX

SEQ ID NO: 22474 - protein, 9 aa, Artificial Sequence
  Description of Artificial Sequence: Synthetic peptide
  Seed: PIIIGCHAY (IDH1 R132C)
  misc_feature (2)..(2): Xaa can be Ala, Leu, Met, Pro, Gln, Ser, Val, Glu, Phe, Gly, Ile, Asn, Thr, Cys, Asp, His, Lys, Arg, Trp, or Tyr
  misc_feature (9)..(9): Xaa can be Tyr, Phe, or Met
PXIIGCHAX

SEQ ID NO: 22475 - protein, 10 aa, Artificial Sequence
  Description of Artificial Sequence: Synthetic peptide
  Seed: VKPIIIGCHA (IDH1 R132C)
  misc_feature (2)..(2): Xaa can be Phe, Met, Ala, Cys, Asp, Glu, Gly, His, Ile, Leu, Asn, Pro, Gln, Arg, Ser, Thr, Val, Trp, Tyr, or Lys
  misc_feature (10)..(10): Xaa can be Ala, or Val
VXPIIIGCHX

SEQ ID NO: 22476 - protein, 11 aa, Artificial Sequence
  Description of Artificial Sequence: Synthetic peptide
  Seed: VKPIIIGCHAY (IDH1 R132C)
  misc_feature (2)..(2): Xaa can be Gln, or Lys
  misc_feature (11)..(11): Xaa can be Phe, Tyr, or Met
VXPIIIGCHAX

SEQ ID NO: 22477 - protein, 8 aa, Artificial Sequence
  Description of Artificial Sequence: Synthetic peptide
  Seed: HHAYGDQY (IDH1 R132H)
  misc_feature (2)..(2): Xaa can be His, Gln, or Arg
  misc_feature (8)..(8): Xaa can be Leu, Phe, Tyr, Ile, Met, Val, or Trp
HXAYGDQX

SEQ ID NO: 22478 - protein, 9 aa, Artificial Sequence
  Description of Artificial Sequence: Synthetic peptide
  Seed: HHAYGDQYR (IDH1 R132H)
  misc_feature (2)..(2): Xaa can be Tyr, Thr, Phe, Val, Ala, Cys, Asp, Glu, Gly, Ile, Leu, Met, Asn, Pro, Gln, Ser, Trp, or Hi s
  misc_feature (9)..(9): Xaa can be Arg, or Lys
HXAYGDQYX

SEQ ID NO: 22479 - protein, 10 aa, Artificial Sequence
  Description of Artificial Sequence: Synthetic peptide
  Seed: HHAYGDQYRA (IDH1 R132H)
  misc_feature (2)..(2): Xaa can be , or His
  misc_feature (10)..(10): Xaa can be Cys, Ile, Leu, Val, or Ala
HXAYGDQYRX

SEQ ID NO: 22480 - protein, 10 aa, Artificial Sequence
  Description of Artificial Sequence: Synthetic peptide
  Seed: IGHHAYGDQY (IDH1 R132H)
  misc_feature (2)..(2): Xaa can be Ala, Gln, Met, Lys, Glu, His, Ile, Leu, Pro, Arg, Ser, Thr, Val, Cys, Phe, Asn, Trp, Tyr, or Gly
  misc_feature (10)..(10): Xaa can be Tyr, Phe, Met, or Leu
IXHHAYGDQX

SEQ ID NO: 22481 - protein, 11 aa, Artificial Sequence
  Description of Artificial Sequence: Synthetic peptide
  Seed: IGHHAYGDQYR (IDH1 R132H)
  misc_feature (2)..(2): Xaa can be Met, Phe, Tyr, Ala, Ile, Leu, Gln, Ser, Thr, Val, Trp, or Gly
  misc_feature (11)..(11): Xaa can be Arg, or Lys
IXHHAYGDQYX

SEQ ID NO: 22482 - protein, 11 aa, Artificial Sequence
  Description of Artificial Sequence: Synthetic peptide
  Seed: IIGHHAYGDQY (IDH1 R132H)
  misc_feature (2)..(2): Xaa can be Ser, Thr, Ala, Met, Val, or Ile
  misc_feature (11)..(11): Xaa can be Tyr, or Lys
IXGHHAYGDQX

SEQ ID NO: 22483 - protein, 8 aa, Artificial Sequence
  Description of Artificial Sequence: Synthetic peptide
  Seed: IIIGHHAY (IDH1 R132H)
  misc_feature (2)..(2): Xaa can be Ala, Ser, Thr, Gln, Gly, Val, Ile, Asn, Glu, Lys, Leu, Met, Cys, Phe, Tyr, Trp, His, Pro, Arg, or Asp
  misc_feature (8)..(8): Xaa can be Tyr, Phe, Leu, Met, Lys, Ile, Val, Trp, His, or Arg
IXIGHHAX

SEQ ID NO: 22484 - protein, 9 aa, Artificial Sequence
  Description of Artificial Sequence: Synthetic peptide
  Seed: KPIIIGHHA (IDH1 R132H)
  misc_feature (2)..(2): Xaa can be Pro, His, Arg, Gln, or Ala
  misc_feature (9)..(9): Xaa can be Ala, Leu, Ile, Val, Met, Cys, Phe, Gly, Pro, Ser, Thr, Trp, or Tyr
KXIIIGHHX

SEQ ID NO: 22485 - protein, 10 aa, Artificial Sequence
  Description of Artificial Sequence: Synthetic peptide
  Seed: KPIIIGHHAY (IDH1 R132H)
  misc_feature (2)..(2): Xaa can be Pro, Gln, Met, Ala, Leu, Ile, Ser, Thr, Val, Cys, Asp, Glu, Phe, Gly, His, Lys, Asn, Arg, Trp, or Tyr
  misc_feature (10)..(10): Xaa can be Tyr, Phe, Met, Leu, Trp, Ile, Val, Ala, Cys, Gly, Pro, Ser, Thr, or His
KXIIIGHHAX

SEQ ID NO: 22486 - protein, 9 aa, Artificial Sequence
  Description of Artificial Sequence: Synthetic peptide
  Seed: PIIIGHHAY (IDH1 R132H)
  misc_feature (2)..(2): Xaa can be Gln, Ala, Pro, Leu, Met, Val, Glu, Ile, Ser, Phe, Thr, Asp, Gly, Asn, Tyr, Cys, His, Lys, Arg, or Trp
  misc_feature (9)..(9): Xaa can be Tyr, Phe, Met, Leu, or Trp
PXIIGHHAX

SEQ ID NO: 22487 - protein, 10 aa, Artificial Sequence
  Description of Artificial Sequence: Synthetic peptide
  Seed: VKPIIIGHHA (IDH1 R132H)
  misc_feature (2)..(2): Xaa can be Met, Phe, Tyr, Ala, Cys, Asp, Glu, Gly, His, Ile, Leu, Asn, Pro, Gln, Arg, Ser, Thr, Val, Trp, or Lys
  misc_feature (10)..(10): Xaa can be Ala, or Val
VXPIIIGHHX

SEQ ID NO: 22488 - protein, 11 aa, Artificial Sequence
  Description of Artificial Sequence: Synthetic peptide
  Seed: VKPIIIGHHAY (IDH1 R132H)
  misc_feature (2)..(2): Xaa can be Gln, Lys, Met, or His
  misc_feature (11)..(11): Xaa can be Tyr, Phe, or Met
VXPIIIGHHAX

SEQ ID NO: 22489 - protein, 9 aa, Artificial Sequence
  Description of Artificial Sequence: Synthetic peptide
  Seed: GAAGVGKSA (KRAS G12A)
  misc_feature (2)..(2): Xaa can be Ala, Pro, Ser, Val, Ile, Thr, Gly, Gln, Asn, Leu, Met, Glu, Cys, Phe, Asp, Tyr, Trp, or Ly s
  misc_feature (9)..(9): Xaa can be Tyr, Lys, Phe, Arg, Met, Leu, Val, His, Ile, Trp, Ala, Cys, Gly, Pro, Gln, Ser, Thr, or Gl u
GXAGVGKSX

SEQ ID NO: 22490 - protein, 10 aa, Artificial Sequence
  Description of Artificial Sequence: Synthetic peptide
  Seed: GAAGVGKSAL (KRAS G12A)
  misc_feature (2)..(2): Xaa can be Pro, Ala, Gln, Ser, Thr, Met, Ile, Val, Gly, Leu, Glu, Arg, Cys, Phe, His, Asn, Tyr, Asp, Lys, or Trp
  misc_feature (10)..(10): Xaa can be Tyr, Phe, Lys, Leu, Arg, Met, His, Trp, Ile, Val, Ala, Cys, Gly, Pro, Gln, Ser, or Thr
GXAGVGKSAX

SEQ ID NO: 22491 - protein, 10 aa, Artificial Sequence
  Description of Artificial Sequence: Synthetic peptide
  Seed: KLVVVGAAGV (KRAS G12A)
  misc_feature (2)..(2): Xaa can be Gln, Leu, Met, Ile, Val, Thr, Ala, Cys, Asp, Glu, Phe, Gly, His, Lys, Asn, Pro, Arg, Ser, Trp, or Tyr
  misc_feature (10)..(10): Xaa can be Val, Ile, Leu, Ala, Met, or Phe
KXVVVGAAGX

SEQ ID NO: 22492 - protein, 9 aa, Artificial Sequence
  Description of Artificial Sequence: Synthetic peptide
  Seed: LVVVGAAGV (KRAS G12A)
  misc_feature (2)..(2): Xaa can be Met, Leu, Gln, Thr, Val, Ile, Ala, or Ser
  misc_feature (9)..(9): Xaa can be Val, Ile, Leu, Ala, Met, or Thr
LXVVGAAGX

SEQ ID NO: 22493 - protein, 11 aa, Artificial Sequence
  Description of Artificial Sequence: Synthetic peptide
  Seed: LVVVGAAGVGK (KRAS G12A)
  misc_feature (2)..(2): Xaa can be Ala, Ser, Thr, Val, Gly, Ile, Gln, Cys, Asp, Glu, Phe, Leu, Met, Asn, Pro, His, Trp, or Ty r
  misc_feature (11)..(11): Xaa can be Lys, Arg, Tyr, Leu, Phe, His, Met, Ile, Val, or Trp
LXVVGAAGVGX

SEQ ID NO: 22494 - protein, 8 aa, Artificial Sequence
  Description of Artificial Sequence: Synthetic peptide
  Seed: VGAAGVGK (KRAS G12A)
  misc_feature (2)..(2): Xaa can be Ala, Ser, Thr, Val, Gly, Ile, Gln, Asp, Phe, Leu, Met, Asn, Cys, or Glu
  misc_feature (8)..(8): Xaa can be Lys, Arg, Tyr, Phe, Leu, Met, His, Ile, or Val
VXAAGVGX

SEQ ID NO: 22495 - protein, 11 aa, Artificial Sequence
  Description of Artificial Sequence: Synthetic peptide
  Seed: VGAAGVGKSAL (KRAS G12A)
  misc_feature (2)..(2): Xaa can be Ala, Ser, Thr, Arg, Gly, Val, Ile, Met, Gln, Cys, Glu, Leu, Asn, Pro, Asp, His, or Phe
  misc_feature (11)..(11): Xaa can be Lys, Leu, Arg, Phe, Tyr, Met, His, Ile, Trp, Val, Ala, or Asn
VXAAGVGKSAX

SEQ ID NO: 22496 - protein, 9 aa, Artificial Sequence
  Description of Artificial Sequence: Synthetic peptide
  Seed: VVGAAGVGK (KRAS G12A)
  misc_feature (2)..(2): Xaa can be Ala, Ser, Thr, Ile, Val, Gly, Met, Gln, Leu, Phe, Cys, Asp, Glu, Asn, Pro, Trp, Tyr, or Hi s
  misc_feature (9)..(9): Xaa can be Lys, Arg, Tyr, Phe, Met, Leu, His, Ile, Val, Ala, or Trp
VXGAAGVGX

SEQ ID NO: 22497 - protein, 10 aa, Artificial Sequence
  Description of Artificial Sequence: Synthetic peptide
  Seed: VVVGAAGVGK (KRAS G12A)
  misc_feature (2)..(2): Xaa can be Ala, Ser, Thr, Val, Met, Gly, Ile, Arg, Leu, Gln, Cys, Pro, Tyr, Glu, Phe, Asn, Trp, Asp, His, or Lys
  misc_feature (10)..(10): Xaa can be Arg, Lys, Tyr, Phe, Leu, Met, His, Gln, Ile, Trp, Val, Ala, or Cys
VXVGAAGVGX

SEQ ID NO: 22498 - protein, 9 aa, Artificial Sequence
  Description of Artificial Sequence: Synthetic peptide
  Seed: GACGVGKSA (KRAS G12C)
  misc_feature (2)..(2): Xaa can be Pro, Ala, Ser, Thr, Val, Ile, Gly, Leu, Met, Gln, Cys, Glu, Asn, Asp, Phe, or Tyr
  misc_feature (9)..(9): Xaa can be Lys, Tyr, Arg, Phe, Met, Leu, His, Val, Ala, Ile, Trp, Cys, Thr, Gln, Gly, Pro, or Ser
GXCGVGKSX

SEQ ID NO: 22499 - protein, 10 aa, Artificial Sequence
  Description of Artificial Sequence: Synthetic peptide
  Seed: GACGVGKSAL (KRAS G12C)
  misc_feature (2)..(2): Xaa can be Pro, Ala, Ser, Thr, Val, Gly, Ile, Leu, Met, Gln, Glu, Arg, Phe, Asn, Cys, Asp, His, or Ty r
  misc_feature (10)..(10): Xaa can be Leu, Lys, Tyr, Met, Phe, Arg, Ile, Val, His, Ala, Trp, Cys, Pro, Ser, or Thr
GXCGVGKSAX

SEQ ID NO: 22500 - protein, 10 aa, Artificial Sequence
  Description of Artificial Sequence: Synthetic peptide
  Seed: KLVVVGACGV (KRAS G12C)
  misc_feature (2)..(2): Xaa can be Gln, Leu, Met, Ile, Val, Thr, Phe, Tyr, Ala, or Ser
  misc_feature (10)..(10): Xaa can be Val, Ile, Leu, Ala, Met, or Phe
KXVVVGACGX

SEQ ID NO: 22501 - protein, 9 aa, Artificial Sequence
  Description of Artificial Sequence: Synthetic peptide
  Seed: LVVVGACGV (KRAS G12C)
  misc_feature (2)..(2): Xaa can be Met, Leu, Gln, Thr, Ile, Val, Ala, or Ser
  misc_feature (9)..(9): Xaa can be Val, Ile, Leu, Ala, Met, or Thr
LXVVGACGX

SEQ ID NO: 22502 - protein, 11 aa, Artificial Sequence
  Description of Artificial Sequence: Synthetic peptide
  Seed: LVVVGACGVGK (KRAS G12C)
  misc_feature (2)..(2): Xaa can be Ala, Ser, Thr, Ile, Val, Cys, Asp, Glu, Phe, Gly, Leu, Met, Asn, Pro, Gln, His, Trp, or Ty r
  misc_feature (11)..(11): Xaa can be Lys, Arg, Tyr, Phe, Leu, His, or Met
LXVVGACGVGX

SEQ ID NO: 22503 - protein, 8 aa, Artificial Sequence
  Description of Artificial Sequence: Synthetic peptide
  Seed: VGACGVGK (KRAS G12C)
  misc_feature (2)..(2): Xaa can be Ala, Ser, Thr, Gly, Ile, Leu, Asn, Gln, Val, Asp, Phe, or Met
  misc_feature (8)..(8): Xaa can be Lys, Arg, Leu, Phe, Tyr, Ile, or Met
VXACGVGX

SEQ ID NO: 22504 - protein, 11 aa, Artificial Sequence
  Description of Artificial Sequence: Synthetic peptide
  Seed: VGACGVGKSAL (KRAS G12C)
  misc_feature (2)..(2): Xaa can be Arg, Ala, Gly, Ile, Ser, Thr, or Val
  misc_feature (11)..(11): Xaa can be Leu, Phe, Met, Lys, Arg, or Tyr
VXACGVGKSAX

SEQ ID NO: 22505 - protein, 9 aa, Artificial Sequence
  Description of Artificial Sequence: Synthetic peptide
  Seed: VVGACGVGK (KRAS G12C)
  misc_feature (2)..(2): Xaa can be Ala, Ser, Thr, Val, Ile, Gly, Met, Gln, Leu, Cys, Asp, Asn, Phe, Trp, Tyr, Glu, Pro, or Hi s
  misc_feature (9)..(9): Xaa can be Lys, Arg, Tyr, Phe, Met, Leu, His, Ile, Val, or Trp
VXGACGVGX

SEQ ID NO: 22506 - protein, 10 aa, Artificial Sequence
  Description of Artificial Sequence: Synthetic peptide
  Seed: VVVGACGVGK (KRAS G12C)
  misc_feature (2)..(2): Xaa can be Ala, Thr, Val, Gly, Ile, Ser, Met, Leu, Gln, Arg, Glu, Phe, Asn, Tyr, Cys, Asp, Pro, His, Lys, or Trp
  misc_feature (10)..(10): Xaa can be Lys, Arg, Tyr, Phe, Met, Leu, His, Gln, Trp, Ala, Ile, or Val
VXVGACGVGX

SEQ ID NO: 22507 - protein, 8 aa, Artificial Sequence
  Description of Artificial Sequence: Synthetic peptide
  Seed: DGVGKSAL (KRAS G12D)
  misc_feature (2)..(2): Xaa can be His, Arg, Gln, Met, Ala, Glu, Phe, Ile, Lys, Leu, Asn, Pro, Ser, or Gly
  misc_feature (8)..(8): Xaa can be Leu, Met, Ile, Val, or Phe
DXVGKSAX

SEQ ID NO: 22508 - protein, 9 aa, Artificial Sequence
  Description of Artificial Sequence: Synthetic peptide
  Seed: GADGVGKSA (KRAS G12D)
  misc_feature (2)..(2): Xaa can be Ala, Pro, Ile, Ser, Thr, Val, Tyr, Phe, Gly, Leu, Met, Cys, Gln, Arg, Trp, Asp, Glu, Asn, His, or Lys
  misc_feature (9)..(9): Xaa can be Leu, Phe, Ile, Met, Val, Tyr, Lys, Arg, Cys, Trp, Ala, Thr, His, Pro, Ser, or Gly
GXDGVGKSX

SEQ ID NO: 22509 - protein, 10 aa, Artificial Sequence
  Description of Artificial Sequence: Synthetic peptide
  Seed: GADGVGKSAL (KRAS G12D)
  misc_feature (2)..(2): Xaa can be Ala, Pro, Ser, Phe, Leu, Met, Thr, Val, Trp, Tyr, Ile, Cys, Gly, Asn, Gln, Arg, Glu, His, Asp, or Lys
  misc_feature (10)..(10): Xaa can be Leu, Phe, Met, Lys, Ile, Val, Tyr, Arg, Trp, Cys, Ala, His, Pro, or Thr
GXDGVGKSAX

SEQ ID NO: 22510 - protein, 11 aa, Artificial Sequence
  Description of Artificial Sequence: Synthetic peptide
  Seed: GADGVGKSALT (KRAS G12D)
  misc_feature (2)..(2): Xaa can be Ala, Ser, Thr, Val, Gly, Ile, Leu, Cys, Phe, Met, Pro, Asn, Gln, Trp, or Tyr
  misc_feature (11)..(11): Xaa can be Leu, Met, Phe, Ile, Val, Trp, Cys, Tyr, Ala, Lys, or Thr
GXDGVGKSALX

SEQ ID NO: 22511 - protein, 10 aa, Artificial Sequence
  Description of Artificial Sequence: Synthetic peptide
  Seed: KLVVVGADGV (KRAS G12D)
  misc_feature (2)..(2): Xaa can be Gln, Leu, Met, Ile, Val, Thr, or Ala
  misc_feature (10)..(10): Xaa can be Val, Ile, Leu, Ala, Met, Phe, or Trp
KXVVVGADGX

SEQ ID NO: 22512 - protein, 9 aa, Artificial Sequence
  Description of Artificial Sequence: Synthetic peptide
  Seed: LVVVGADGV (KRAS G12D)
  misc_feature (2)..(2): Xaa can be Leu, Met, Ile, Val, Thr, Gln, Ala, or Ser
  misc_feature (9)..(9): Xaa can be Val, Leu, Ile, Ala, or Met
LXVVGADGX

SEQ ID NO: 22513 - protein, 11 aa, Artificial Sequence
  Description of Artificial Sequence: Synthetic peptide
  Seed: LVVVGADGVGK (KRAS G12D)
  misc_feature (2)..(2): Xaa can be Ala, Gly, Val, Ser, Thr, Ile, Leu, Met, Gln, Cys, Asp, Glu, Phe, His, Lys, Asn, Pro, Trp, or Tyr
  misc_feature (11)..(11): Xaa can be Lys, Arg, Tyr, Phe, His, Leu, Met, Gln, Ile, or Trp
LXVVGADGVGX

SEQ ID NO: 22514 - protein, 8 aa, Artificial Sequence
  Description of Artificial Sequence: Synthetic peptide
  Seed: VGADGVGK (KRAS G12D)
  misc_feature (2)..(2): Xaa can be Ala, Ser, Val, Thr, Ile, Gly, Leu, Met, Gln, Cys, Asp, Glu, Phe, Asn, Trp, Tyr, His, Pro, or Arg
  misc_feature (8)..(8): Xaa can be Lys, Arg, Tyr, Leu, Phe, Met, His, Ile, or Val
VXADGVGX

SEQ ID NO: 22515 - protein, 10 aa, Artificial Sequence
  Description of Artificial Sequence: Synthetic peptide
  Seed: VGADGVGKSA (KRAS G12D)
  misc_feature (2)..(2): Xaa can be Ala, Pro, Ser, Thr, Val, Ile, Met, Gln, Leu, Gly, Glu, Asn, Cys, Phe, Asp, Lys, Tyr, Arg, Trp, or His
  misc_feature (10)..(10): Xaa can be Phe, Tyr, Met, Lys, Leu, His, Arg, Ile, Val, Trp, Ala, Cys, Gln, Thr, Ser, Glu, Gly, Asn, or Pro
VXADGVGKSX

SEQ ID NO: 22516 - protein, 11 aa, Artificial Sequence
  Description of Artificial Sequence: Synthetic peptide
  Seed: VGADGVGKSAL (KRAS G12D)
  misc_feature (2)..(2): Xaa can be Pro, Ala, Arg, Gly, Val, Thr, Ser, Ile, Leu, Met, Gln, Tyr, Glu, His, Cys, Phe, Asn, Lys, Trp, or Asp
  misc_feature (11)..(11): Xaa can be Phe, Leu, Lys, Arg, Trp, Tyr, Met, Ile, His, Val, Gln, Ala, Cys, Asn, Ser, Thr, Glu, Gly, or Pro
VXADGVGKSAX

SEQ ID NO: 22517 - protein, 9 aa, Artificial Sequence
  Description of Artificial Sequence: Synthetic peptide
  Seed: VVGADGVGK (KRAS G12D)
  misc_feature (2)..(2): Xaa can be Ala, Ser, Thr, Val, Ile, Met, Gly, Gln, Leu, Cys, Asp, Asn, Tyr, Glu, Phe, His, Pro, or Tr p
  misc_feature (9)..(9): Xaa can be Lys, Arg, Tyr, Phe, Met, His, Leu, Ile, or Val
VXGADGVGX

SEQ ID NO: 22518 - protein, 10 aa, Artificial Sequence
  Description of Artificial Sequence: Synthetic peptide
  Seed: VVVGADGVGK (KRAS G12D)
  misc_feature (2)..(2): Xaa can be Ala, Thr, Val, Ser, Ile, Met, Gly, Leu, Gln, Asn, Cys, Arg, Tyr, Pro, Glu, Phe, Trp, Asp, His, or Lys
  misc_feature (10)..(10): Xaa can be Arg, Lys, Tyr, Phe, Leu, Met, Gln, His, Glu, Trp, Ile, Val, Ala, Cys, or Asn
VXVGADGVGX

SEQ ID NO: 22519 - protein, 9 aa, Artificial Sequence
  Description of Artificial Sequence: Synthetic peptide
  Seed: GARGVGKSA (KRAS G12R)
  misc_feature (2)..(2): Xaa can be Pro, Ala, Val, Ile, Ser, Thr, Gly, Leu, Met, Gln, Cys, Glu, Asn, Asp, Phe, or Tyr
  misc_feature (9)..(9): Xaa can be Tyr, Phe, Leu, Met, His, Ala, Val, Ile, Trp, Cys, Lys, Pro, Gln, Arg, Ser, Thr, Glu, Gly, or Asn
GXRGVGKSX

SEQ ID NO: 22520 - protein, 10 aa, Artificial Sequence
  Description of Artificial Sequence: Synthetic peptide
  Seed: GARGVGKSAL (KRAS G12R)
  misc_feature (2)..(2): Xaa can be Pro, Ala, Thr, Val, Ser, Ile, Gln, Leu, Met, Arg, Glu, Gly, Cys, or His
  misc_feature (10)..(10): Xaa can be Leu, Tyr, Phe, Met, His, Val, Ile, Trp, Ala, Cys, Gly, Pro, Ser, Thr, Lys, Asn, Gln, or Ar g
GXRGVGKSAX

SEQ ID NO: 22521 - protein, 10 aa, Artificial Sequence
  Description of Artificial Sequence: Synthetic peptide
  Seed: KLVVVGARGV (KRAS G12R)
  misc_feature (2)..(2): Xaa can be Gln, Leu, Met, Ile, Val, or Thr
  misc_feature (10)..(10): Xaa can be Val, Ala, Ile, Leu, Phe, or Met
KXVVVGARGX

SEQ ID NO: 22522 - protein, 9 aa, Artificial Sequence
  Description of Artificial Sequence: Synthetic peptide
  Seed: LVVVGARGV (KRAS G12R)
  misc_feature (2)..(2): Xaa can be Leu, Met, Gln, Ile, Thr, or Val
  misc_feature (9)..(9): Xaa can be Val, Leu, Ile, Ala, or Met
LXVVGARGX

SEQ ID NO: 22523 - protein, 11 aa, Artificial Sequence
  Description of Artificial Sequence: Synthetic peptide
  Seed: LVVVGARGVGK (KRAS G12R)
  misc_feature (2)..(2): Xaa can be Ala, Ser, Thr, Val, Asp, Gly, Ile, Leu, Met, Asn, Gln, Cys, or Glu
  misc_feature (11)..(11): Xaa can be Lys, Arg, Tyr, Phe, His, Leu, or Met
LXVVGARGVGX

SEQ ID NO: 22524 - protein, 10 aa, Artificial Sequence
  Description of Artificial Sequence: Synthetic peptide
  Seed: RGVGKSALTI (KRAS G12R)
  misc_feature (2)..(2): Xaa can be Arg, Gly, Gln, Lys, Glu, Ala, His, Asn, Met, Ser, Ile, Leu, Thr, Cys, Asp, or Val
  misc_feature (10)..(10): Xaa can be Leu, Phe, Lys, Tyr, Arg, Met, Ile, Ala, Cys, Glu, Gly, His, Asn, Pro, Gln, Ser, Thr, Val, or Trp
RXVGKSALTX

SEQ ID NO: 22525 - protein, 8 aa, Artificial Sequence
  Description of Artificial Sequence: Synthetic peptide
  Seed: VGARGVGK (KRAS G12R)
  misc_feature (2)..(2): Xaa can be Ala, Gly, Ile, Ser, Val, Leu, or Thr
  misc_feature (8)..(8): Xaa can be Lys, Arg, Leu, Phe, Ile, or Met
VXARGVGX

SEQ ID NO: 22526 - protein, 9 aa, Artificial Sequence
  Description of Artificial Sequence: Synthetic peptide
  Seed: VVGARGVGK (KRAS G12R)
  misc_feature (2)..(2): Xaa can be Ala, Ser, Thr, Met, Ile, Leu, Val, Phe, Gly, Asp, Tyr, Glu, Asn, Pro, Gln, or Trp
  misc_feature (9)..(9): Xaa can be Arg, Lys, Tyr, Met, Leu, Phe, Ile, Val, Trp, or His
VXGARGVGX

SEQ ID NO: 22527 - protein, 10 aa, Artificial Sequence
  Description of Artificial Sequence: Synthetic peptide
  Seed: VVVGARGVGK (KRAS G12R)
  misc_feature (2)..(2): Xaa can be Ala, Ser, Thr, Val, Met, Ile, Gln, Gly, Leu, Pro, Phe, Cys, Glu, Asn, Asp, Tyr, His, Trp, Lys, or Arg
  misc_feature (10)..(10): Xaa can be Lys, Arg, Tyr, Phe, Leu, Met, His, Ile, Trp, Val, Ala, or Cys
VXVGARGVGX

SEQ ID NO: 22528 - protein, 9 aa, Artificial Sequence
  Description of Artificial Sequence: Synthetic peptide
  Seed: GASGVGKSA (KRAS G12S)
  misc_feature (2)..(2): Xaa can be Ala, Pro, Ile, Ser, Thr, Val, Gly, Gln, Leu, Met, Cys, Glu, Phe, Asn, Asp, Tyr, or Trp
  misc_feature (9)..(9): Xaa can be Lys, Tyr, Phe, Met, Arg, Leu, His, Ile, Val, Trp, Ala, Cys, Pro, Ser, Thr, Gln, or Gly
GXSGVGKSX

SEQ ID NO: 22529 - protein, 10 aa, Artificial Sequence
  Description of Artificial Sequence: Synthetic peptide
  Seed: GASGVGKSAL (KRAS G12S)
  misc_feature (2)..(2): Xaa can be Pro, Ala, Ser, Gln, Ile, Met, Thr, Val, Leu, Gly, Arg, Glu, Cys, Phe, His, Asn, Tyr, Asp, Lys, or Trp
  misc_feature (10)..(10): Xaa can be Phe, Tyr, Leu, Lys, Met, Arg, His, Trp, Ile, Val, Ala, Cys, Gly, Pro, Ser, or Thr
GXSGVGKSAX

SEQ ID NO: 22530 - protein, 10 aa, Artificial Sequence
  Description of Artificial Sequence: Synthetic peptide
  Seed: KLVVVGASGV (KRAS G12S)
  misc_feature (2)..(2): Xaa can be Gln, Leu, Met, Ile, Val, Thr, Ala, Cys, Asp, Glu, Phe, Gly, His, Lys, Asn, Pro, Arg, Ser, Trp, or Tyr
  misc_feature (10)..(10): Xaa can be Val, Ile, Leu, Ala, Met, Phe, or Trp
KXVVVGASGX

SEQ ID NO: 22531 - protein, 9 aa, Artificial Sequence
  Description of Artificial Sequence: Synthetic peptide
  Seed: LVVVGASGV (KRAS G12S)
  misc_feature (2)..(2): Xaa can be Met, Leu, Gln, Thr, Ile, Val, Ala, or Ser
  misc_feature (9)..(9): Xaa can be Val, Ile, Leu, Ala, Met, or Thr
LXVVGASGX

SEQ ID NO: 22532 - protein, 11 aa, Artificial Sequence
  Description of Artificial Sequence: Synthetic peptide
  Seed: LVVVGASGVGK (KRAS G12S)
  misc_feature (2)..(2): Xaa can be Ala, Ser, Thr, Val, Gly, Ile, Met, Gln, Cys, Asp, Glu, Phe, His, Leu, Asn, Pro, Trp, or Ty r
  misc_feature (11)..(11): Xaa can be Lys, Arg, Tyr, Leu, Phe, His, Met, Ile, or Trp
LXVVGASGVGX

SEQ ID NO: 22533 - protein, 8 aa, Artificial Sequence
  Description of Artificial Sequence: Synthetic peptide
  Seed: VGASGVGK (KRAS G12S)
  misc_feature (2)..(2): Xaa can be Ala, Ser, Thr, Val, Gly, Ile, Gln, Asp, Phe, Leu, Met, Asn, Cys, or Glu
  misc_feature (8)..(8): Xaa can be Lys, Arg, Tyr, Phe, Leu, Met, His, Ile, or Val
VXASGVGX

SEQ ID NO: 22534 - protein, 11 aa, Artificial Sequence
  Description of Artificial Sequence: Synthetic peptide
  Seed: VGASGVGKSAL (KRAS G12S)
  misc_feature (2)..(2): Xaa can be Ala, Arg, Ser, Thr, Val, Gly, Gln, Ile, Leu, Met, Cys, Glu, Asn, Pro, Phe, His, Asp, Tyr, or Trp
  misc_feature (11)..(11): Xaa can be Lys, Leu, Arg, Tyr, Phe, Met, His, Ile, Trp, Val, Ala, Cys, Gln, or Asn
VXASGVGKSAX

SEQ ID NO: 22535 - protein, 9 aa, Artificial Sequence
  Description of Artificial Sequence: Synthetic peptide
  Seed: VVGASGVGK (KRAS G12S)
  misc_feature (2)..(2): Xaa can be Ala, Ile, Ser, Thr, Val, Gly, Leu, Met, Gln, Phe, Cys, Asp, Asn, Glu, Pro, Trp, Tyr, or Hi s
  misc_feature (9)..(9): Xaa can be Lys, Arg, Tyr, Phe, Met, His, Leu, Ala, Ile, Val, or Trp
VXGASGVGX

SEQ ID NO: 22536 - protein, 10 aa, Artificial Sequence
  Description of Artificial Sequence: Synthetic peptide
  Seed: VVVGASGVGK (KRAS G12S)
  misc_feature (2)..(2): Xaa can be Ala, Thr, Ser, Val, Gly, Ile, Leu, Met, Arg, Gln, Cys, Pro, Tyr, Asn, Glu, Phe, Trp, Asp, His, or Lys
  misc_feature (10)..(10): Xaa can be Lys, Arg, Tyr, Phe, Met, Leu, His, Gln, Trp, Ile, Val, Ala, Cys, or Glu
VXVGASGVGX

SEQ ID NO: 22537 - protein, 9 aa, Artificial Sequence
  Description of Artificial Sequence: Synthetic peptide
  Seed: GAVGVGKSA (KRAS G12V)
  misc_feature (2)..(2): Xaa can be Pro, Ala, Ile, Ser, Thr, Val, Gly, Gln, Leu, Met, Asn, Cys, Glu, Phe, Asp, Tyr, His, or Tr p
  misc_feature (9)..(9): Xaa can be Lys, Tyr, Phe, Arg, Met, Leu, His, Val, Ile, Trp, Ala, Cys, Pro, Gln, Ser, Thr, Glu, or Gl y
GXVGVGKSX

SEQ ID NO: 22538 - protein, 10 aa, Artificial Sequence
  Description of Artificial Sequence: Synthetic peptide
  Seed: GAVGVGKSAL (KRAS G12V)
  misc_feature (2)..(2): Xaa can be Pro, Ala, Gln, Met, Val, Ile, Leu, Ser, Thr, Glu, Gly, Arg, Cys, Asn, Asp, Phe, His, Tyr, Lys, or Trp
  misc_feature (10)..(10): Xaa can be Tyr, Phe, Lys, Leu, Met, Arg, Trp, His, Ile, Val, Ala, Cys, Gly, Pro, Ser, or Thr
GXVGVGKSAX

SEQ ID NO: 22539 - protein, 10 aa, Artificial Sequence
  Description of Artificial Sequence: Synthetic peptide
  Seed: KLVVVGAVGV (KRAS G12V)
  misc_feature (2)..(2): Xaa can be Gln, Leu, Met, Ile, Val, Thr, Glu, Ala, Phe, Ser, or Tyr
  misc_feature (10)..(10): Xaa can be Val, Leu, Ile, Ala, Met, Cys, Phe, or Trp
KXVVVGAVGX

SEQ ID NO: 22540 - protein, 9 aa, Artificial Sequence
  Description of Artificial Sequence: Synthetic peptide
  Seed: LVVVGAVGV (KRAS G12V)
  misc_feature (2)..(2): Xaa can be Met, Leu, Thr, Ile, Gln, Val, Ala, or Ser
  misc_feature (9)..(9): Xaa can be Val, Ile, Leu, Ala, Met, or Thr
LXVVGAVGX

SEQ ID NO: 22541 - protein, 11 aa, Artificial Sequence
  Description of Artificial Sequence: Synthetic peptide
  Seed: LVVVGAVGVGK (KRAS G12V)
  misc_feature (2)..(2): Xaa can be Ala, Ser, Thr, Gly, Ile, Val, Cys, Asp, Glu, Phe, Leu, Met, Asn, Pro, Gln, His, Trp, or Ty r
  misc_feature (11)..(11): Xaa can be Lys, Arg, Tyr, Phe, Leu, His, Ile, or Met
LXVVGAVGVGX

SEQ ID NO: 22542 - protein, 8 aa, Artificial Sequence
  Description of Artificial Sequence: Synthetic peptide
  Seed: VGAVGVGK (KRAS G12V)
  misc_feature (2)..(2): Xaa can be Ala, Ser, Thr, Gly, Val, Ile, Gln, Asp, Glu, Phe, Leu, Met, Asn, Cys, or Pro
  misc_feature (8)..(8): Xaa can be Lys, Arg, Tyr, Phe, Leu, Ile, Met, His, or Val
VXAVGVGX

SEQ ID NO: 22543 - protein, 11 aa, Artificial Sequence
  Description of Artificial Sequence: Synthetic peptide
  Seed: VGAVGVGKSAL (KRAS G12V)
  misc_feature (2)..(2): Xaa can be Ala, Ser, Thr, Val, Gly, Cys, Asp, Glu, Ile, Leu, Met, Asn, Gln, or Phe
  misc_feature (11)..(11): Xaa can be Lys, Arg, Phe, Leu, Tyr, Met, Ile, or Trp
VXAVGVGKSAX

SEQ ID NO: 22544 - protein, 10 aa, Artificial Sequence
  Description of Artificial Sequence: Synthetic peptide
  Seed: VGVGKSALTI (KRAS G12V)
  misc_feature (2)..(2): Xaa can be Arg, Gly, Ala, Cys, Ile, Leu, Met, Asn, Gln, Ser, Thr, or Val
  misc_feature (10)..(10): Xaa can be Leu, Phe, Ile, His, Lys, Met, Arg, Val, Trp, or Tyr
VXVGKSALTX

SEQ ID NO: 22545 - protein, 9 aa, Artificial Sequence
  Description of Artificial Sequence: Synthetic peptide
  Seed: VVGAVGVGK (KRAS G12V)
  misc_feature (2)..(2): Xaa can be Ala, Ser, Thr, Gly, Ile, Val, Met, Phe, Leu, Tyr, Arg, Gln, Cys, Asp, Glu, Asn, Pro, Trp, or His
  misc_feature (9)..(9): Xaa can be Lys, Arg, Tyr, Phe, Met, Leu, His, Ile, Val, Trp, Ala, or Gln
VXGAVGVGX

SEQ ID NO: 22546 - protein, 10 aa, Artificial Sequence
  Description of Artificial Sequence: Synthetic peptide
  Seed: VVVGAVGVGK (KRAS G12V)
  misc_feature (2)..(2): Xaa can be Ala, Ser, Thr, Met, Gly, Val, Ile, Leu, Arg, Gln, Tyr, Cys, Asn, Pro, Glu, Phe, Trp, Asp, His, or Lys
  misc_feature (10)..(10): Xaa can be Lys, Arg, Tyr, Phe, Leu, Met, His, Gln, Val, Ile, Trp, Glu, Ala, Cys, or Asn
VXVGAVGVGX

SEQ ID NO: 22547 - protein, 9 aa, Artificial Sequence
  Description of Artificial Sequence: Synthetic peptide
  Seed: AGDVGKSAL (KRAS G13D)
  misc_feature (2)..(2): Xaa can be Ala, Ser, Ile, Thr, Val, Tyr, Glu, Phe, Gly, Leu, Met, Asp, Trp, Cys, Gln, Arg, Asn, Pro, His, or Lys
  misc_feature (9)..(9): Xaa can be Leu, Met, Phe, Ile, Val, Tyr, Lys, Cys, Trp, Ala, Arg, Thr, His, Pro, or Ser
AXDVGKSAX

SEQ ID NO: 22548 - protein, 11 aa, Artificial Sequence
  Description of Artificial Sequence: Synthetic peptide
  Seed: AGDVGKSALTI (KRAS G13D)
  misc_feature (2)..(2): Xaa can be Ala, Phe, Ser, Thr, Val, Tyr, Cys, Gly, Ile, Leu, Trp, Met, Arg, Asn, Pro, Gln, His, Asp, Glu, or Lys
  misc_feature (11)..(11): Xaa can be Leu, Phe, Met, Ile, Val, Cys, Trp, Tyr, Ala, His, Lys, or Thr
AXDVGKSALTX

SEQ ID NO: 22549 - protein, 9 aa, Artificial Sequence
  Description of Artificial Sequence: Synthetic peptide
  Seed: DVGKSALTI (KRAS G13D)
  misc_feature (2)..(2): Xaa can be Ala, Val, Ile, Thr, Leu, Met, Ser, Pro, Gln, Glu, Gly, Cys, or Asn
  misc_feature (9)..(9): Xaa can be Val, Ile, Leu, Tyr, Phe, Trp, Met, Ala, or Cys
DXGKSALTX

SEQ ID NO: 22550 - protein, 9 aa, Artificial Sequence
  Description of Artificial Sequence: Synthetic peptide
  Seed: GAGDVGKSA (KRAS G13D)
  misc_feature (2)..(2): Xaa can be Ala, Pro, Ile, Ser, Thr, Val, Gln, Gly, Leu, Met, Asn, Cys, Glu, Asp, Phe, Trp, or Tyr
  misc_feature (9)..(9): Xaa can be Lys, Arg, Tyr, Phe, Met, Leu, His, Ile, Val, Trp, Ala, Cys, Thr, Gln, Gly, Pro, or Ser
GXGDVGKSX

SEQ ID NO: 22551 - protein, 10 aa, Artificial Sequence
  Description of Artificial Sequence: Synthetic peptide
  Seed: GAGDVGKSAL (KRAS G13D)
  misc_feature (2)..(2): Xaa can be Pro, Ala, Ser, Thr, Ile, Gln, Val, Met, Arg, Glu, Leu, Tyr, Cys, Phe, Gly, Asn, His, Trp, Asp, or Lys
  misc_feature (10)..(10): Xaa can be Leu, Phe, Lys, Arg, Tyr, Met, Ile, Trp, His, Val, Ala, Cys, Pro, or Thr
GXGDVGKSAX

SEQ ID NO: 22552 - protein, 10 aa, Artificial Sequence
  Description of Artificial Sequence: Synthetic peptide
  Seed: KLVVVGAGDV (KRAS G13D)
  misc_feature (2)..(2): Xaa can be Met, Leu, Ile, Gln, or Val
  misc_feature (10)..(10): Xaa can be Val, Ala, Ile, or Leu
KXVVVGAGDX

SEQ ID NO: 22553 - protein, 9 aa, Artificial Sequence
  Description of Artificial Sequence: Synthetic peptide
  Seed: LVVVGAGDV (KRAS G13D)
  misc_feature (2)..(2): Xaa can be Met, Leu, Ile, or Val
  misc_feature (9)..(9): Xaa can be Val, Leu, or Ile
LXVVGAGDX

SEQ ID NO: 22554 - protein, 11 aa, Artificial Sequence
  Description of Artificial Sequence: Synthetic peptide
  Seed: LVVVGAGDVGK (KRAS G13D)
  misc_feature (2)..(2): Xaa can be Ala, Ser, Thr, Val, Gly, Ile, Cys, Asp, Glu, Phe, His, Leu, Met, Asn, Pro, Gln, Trp, Tyr, or Lys
  misc_feature (11)..(11): Xaa can be Lys, Arg, Tyr, Leu, Phe, Gln, His, or Met
LXVVGAGDVGX

SEQ ID NO: 22555 - protein, 8 aa, Artificial Sequence
  Description of Artificial Sequence: Synthetic peptide
  Seed: VGAGDVGK (KRAS G13D)
  misc_feature (2)..(2): Xaa can be Ala, Phe, Gly, Ile, Leu, Met, Asn, Gln, Ser, Thr, Val, Asp, or Glu
  misc_feature (8)..(8): Xaa can be Lys, Arg, or Tyr
VXAGDVGX

SEQ ID NO: 22556 - protein, 11 aa, Artificial Sequence
  Description of Artificial Sequence: Synthetic peptide
  Seed: VGAGDVGKSAL (KRAS G13D)
  misc_feature (2)..(2): Xaa can be Ala, Val, Ser, Gly, Arg, Thr, Ile, Leu, Met, Gln, Glu, Pro, Cys, Phe, Asn, His, Tyr, Asp, Trp, or Lys
  misc_feature (11)..(11): Xaa can be Trp, Lys, Leu, Phe, Arg, Tyr, Met, His, Ile, Val, Ala, Glu, or Asn
VXAGDVGKSAX

SEQ ID NO: 22557 - protein, 9 aa, Artificial Sequence
  Description of Artificial Sequence: Synthetic peptide
  Seed: VVGAGDVGK (KRAS G13D)
  misc_feature (2)..(2): Xaa can be Ala, Ser, Thr, Val, Ile, Leu, Met, Gly, Asn, Gln, Cys, Asp, Glu, Phe, Pro, Trp, Tyr, or Hi s
  misc_feature (9)..(9): Xaa can be Lys, Arg, Tyr, Phe, Leu, Met, His, Ile, or Val
VXGAGDVGX

SEQ ID NO: 22558 - protein, 10 aa, Artificial Sequence
  Description of Artificial Sequence: Synthetic peptide
  Seed: VVVGAGDVGK (KRAS G13D)
  misc_feature (2)..(2): Xaa can be Ala, Val, Thr, Ser, Gly, Ile, Met, Leu, Arg, Gln, Phe, Cys, Asp, Glu, Asn, Tyr, His, Lys, Pro, or Trp
  misc_feature (10)..(10): Xaa can be Arg, Lys, Tyr, Phe, Leu, Met, Gln, His, Glu, Ile, Val, or Trp
VXVGAGDVGX

SEQ ID NO: 22559 - protein, 9 aa, Artificial Sequence
  Description of Artificial Sequence: Synthetic peptide
  Seed: AGKEEYSAM (NRAS Q61K)
  misc_feature (2)..(2): Xaa can be Ala, Pro, Ser, Val, Arg, Gln, Gly, Ile, Met, Thr, Glu, Leu, Asp, Asn, Cys, Phe, His, Tyr, Lys, or Trp
  misc_feature (9)..(9): Xaa can be Leu, Tyr, Phe, Met, Ile, Val, His, Trp, Ala, Lys, Cys, Arg, Gln, Thr, Gly, Pro, Ser, Glu, or Asn
AXKEEYSAX

SEQ ID NO: 22560 - protein, 10 aa, Artificial Sequence
  Description of Artificial Sequence: Synthetic peptide
  Seed: AGKEEYSAMR (NRAS Q61K)
  misc_feature (2)..(2): Xaa can be Phe, Met, Trp, Tyr, Thr, Ala, Ile, Leu, Gln, Ser, Val, Asn, or Gly
  misc_feature (10)..(10): Xaa can be Arg, or Lys
AXKEEYSAMX

SEQ ID NO: 22561 - protein, 11 aa, Artificial Sequence
  Description of Artificial Sequence: Synthetic peptide
  Seed: DILDTAGKEEY (NRAS Q61K)
  misc_feature (2)..(2): Xaa can be Val, Thr, Gln, Met, Ala, Glu, Ile, Leu, Pro, Ser, Gly, Phe, Asn, Cys, Asp, Tyr, His, Lys, or Trp
  misc_feature (11)..(11): Xaa can be Tyr, Arg, Lys, Phe, Trp, Met, Leu, His, or Gln
DXLDTAGKEEX

SEQ ID NO: 22562 - protein, 11 aa, Artificial Sequence
  Description of Artificial Sequence: Synthetic peptide
  Seed: DTAGKEEYSAM (NRAS Q61K)
  misc_feature (2)..(2): Xaa can be Thr, Val, Ala, Cys, Asp, Glu, Phe, Gly, Ile, Leu, Met, Asn, Gln, or Ser
  misc_feature (11)..(11): Xaa can be Lys, Arg, His, Tyr, or Met
DXAGKEEYSAX

SEQ ID NO: 22563 - protein, 10 aa, Artificial Sequence
  Description of Artificial Sequence: Synthetic peptide
  Seed: ILDTAGKEEY (NRAS Q61K)
  misc_feature (2)..(2): Xaa can be Thr, Val, Met, Ala, Ile, Ser, Leu, Phe, Tyr, Trp, Glu, Gly, Asn, Pro, Gln, Cys, Asp, His, Lys, or Arg
  misc_feature (10)..(10): Xaa can be Tyr, Leu, Phe, Met, Trp, Ile, Lys, Val, Arg, Cys, Ala, His, Thr, or Gln
IXDTAGKEEX

SEQ ID NO: 22564 - protein, 11 aa, Artificial Sequence
  Description of Artificial Sequence: Synthetic peptide
  Seed: KEEYSAMRDQY (NRAS Q61K)
  misc_feature (2)..(2): Xaa can be Glu, Asp, or Gln
  misc_feature (11)..(11): Xaa can be Trp, Phe, Leu, Met, or Tyr
KXEYSAMRDQX

SEQ ID NO: 22565 - protein, 9 aa, Artificial Sequence
  Description of Artificial Sequence: Synthetic peptide
  Seed: LDTAGKEEY (NRAS Q61K)
  misc_feature (2)..(2): Xaa can be Glu, Asp, Gln, Ala, Ile, Leu, Met, Val, Pro, Ser, Thr, Phe, Gly, Asn, Tyr, Cys, His, Lys, Arg, or Trp
  misc_feature (9)..(9): Xaa can be Tyr, Phe, Met, Lys, Leu, Trp, Ile, Val, Ala, Cys, His, or Arg
LXTAGKEEX

SEQ ID NO: 22566 - protein, 10 aa, Artificial Sequence
  Description of Artificial Sequence: Synthetic peptide
  Seed: TAGKEEYSAM (NRAS Q61K)
  misc_feature (2)..(2): Xaa can be Ala, Ile, Ser, Thr, Val, Leu, Met, or Gln
  misc_feature (10)..(10): Xaa can be Tyr, Phe, Leu, or Met
TXGKEEYSAX

SEQ ID NO: 22567 - protein, 11 aa, Artificial Sequence
  Description of Artificial Sequence: Synthetic peptide
  Seed: TAGKEEYSAMR (NRAS Q61K)
  misc_feature (2)..(2): Xaa can be Val, Phe, Ile, Thr, Tyr, or Ala
  misc_feature (11)..(11): Xaa can be Arg, or Lys
TXGKEEYSAMX

SEQ ID NO: 22568 - protein, 9 aa, Artificial Sequence
  Description of Artificial Sequence: Synthetic peptide
  Seed: AGLEEYSAM (NRAS Q61L)
  misc_feature (2)..(2): Xaa can be Ala, Gln, Arg, Ser, Val, Thr, Ile, Leu, Glu, Gly, Met, Asn, Lys, His, Tyr, Asp, Cys, Phe, Pro, or Trp
  misc_feature (9)..(9): Xaa can be Phe, Leu, Met, Tyr, Ile, Val, Lys, His, Trp, Arg, Ala, Cys, Gly, Gln, Ser, or Thr
AXLEEYSAX

SEQ ID NO: 22569 - protein, 10 aa, Artificial Sequence
  Description of Artificial Sequence: Synthetic peptide
  Seed: AGLEEYSAMR (NRAS Q61L)
  misc_feature (2)..(2): Xaa can be Ala, Phe, Ile, Leu, Met, Gln, Ser, Thr, Val, Trp, Tyr, Gly, or Asn
  misc_feature (10)..(10): Xaa can be Arg, Lys, or Leu
AXLEEYSAMX

SEQ ID NO: 22570 - protein, 11 aa, Artificial Sequence
  Description of Artificial Sequence: Synthetic peptide
  Seed: DILDTAGLEEY (NRAS Q61L)
  misc_feature (2)..(2): Xaa can be Val, Thr, Ile, Ala, Pro, Gln, Met, Glu, Gly, Leu, Ser, Cys, Phe, Asn, Tyr, Asp, Trp, His, or Lys
  misc_feature (11)..(11): Xaa can be Arg, Tyr, Lys, Trp, Phe, Met, Leu, His, or Gln
DXLDTAGLEEX

SEQ ID NO: 22571 - protein, 10 aa, Artificial Sequence
  Description of Artificial Sequence: Synthetic peptide
  Seed: DTAGLEEYSA (NRAS Q61L)
  misc_feature (2)..(2): Xaa can be Thr, Val, Ile, Ala, Ser, Leu, or Met
  misc_feature (10)..(10): Xaa can be Val, Ile, Leu, Ala, or Met
DXAGLEEYSX

SEQ ID NO: 22572 - protein, 11 aa, Artificial Sequence
  Description of Artificial Sequence: Synthetic peptide
  Seed: DTAGLEEYSAM (NRAS Q61L)
  misc_feature (2)..(2): Xaa can be Thr, Val, or Ile
  misc_feature (11)..(11): Xaa can be Tyr, Phe, or Met
DXAGLEEYSAX

SEQ ID NO: 22573 - protein, 9 aa, Artificial Sequence
  Description of Artificial Sequence: Synthetic peptide
  Seed: ILDTAGLEE (NRAS Q61L)
  misc_feature (2)..(2): Xaa can be Ala, Ile, Ser, Thr, Val, Leu, Met, Gly, Phe, Gln, Cys, Asn, Pro, Trp, Tyr, Asp, Glu, His, Lys, or Arg
  misc_feature (9)..(9): Xaa can be Phe, Ile, Leu, Met, Val, Cys, Trp, Tyr, Ala, Thr, Lys, Pro, Ser, Gln, Arg, Gly, Glu, His, Asn, or Asp
IXDTAGLEX

SEQ ID NO: 22574 - protein, 10 aa, Artificial Sequence
  Description of Artificial Sequence: Synthetic peptide
  Seed: ILDTAGLEEY (NRAS Q61L)
  misc_feature (2)..(2): Xaa can be Ser, Thr, Met, Val, Ala, Ile, Leu, Phe, Trp, Tyr, Gly, Pro, Gln, Glu, Asn, Cys, Asp, His, Lys, or Arg
  misc_feature (10)..(10): Xaa can be Tyr, Phe, Leu, Met, Lys, Ile, Val, Arg, Trp, Cys, Ala, Thr, His, Gln, or Ser
IXDTAGLEEX

SEQ ID NO: 22575 - protein, 9 aa, Artificial Sequence
  Description of Artificial Sequence: Synthetic peptide
  Seed: LDTAGLEEY (NRAS Q61L)
  misc_feature (2)..(2): Xaa can be Glu, Ala, Met, Gln, Ser, Thr, Val, Asp, Ile, Gly, Leu, Pro, Asn, Cys, Phe, Lys, Arg, Trp, Tyr, or His
  misc_feature (9)..(9): Xaa can be Tyr, Phe, Met, Lys, Leu, His, Ile, Val, Arg, Trp, Ala, or Cys
LXTAGLEEX

SEQ ID NO: 22576 - protein, 11 aa, Artificial Sequence
  Description of Artificial Sequence: Synthetic peptide
  Seed: LEEYSAMRDQY (NRAS Q61L)
  misc_feature (2)..(2): Xaa can be , or Glu
  misc_feature (11)..(11): Xaa can be Phe, Trp, or Tyr
LXEYSAMRDQX

SEQ ID NO: 22577 - protein, 9 aa, Artificial Sequence
  Description of Artificial Sequence: Synthetic peptide
  Seed: AGREEYSAM (NRAS Q61R)
  misc_feature (2)..(2): Xaa can be Pro, Ala, Gln, Arg, Ser, Val, Ile, Met, Thr, Glu, His, Lys, Leu, Gly, Asn, Tyr, Cys, Phe, Asp, or Trp
  misc_feature (9)..(9): Xaa can be Phe, Tyr, Leu, Met, Ile, His, Val, Trp, Ala, Cys, Arg, Gln, Ser, Thr, Lys, Gly, or Pro
AXREEYSAX

SEQ ID NO: 22578 - protein, 10 aa, Artificial Sequence
  Description of Artificial Sequence: Synthetic peptide
  Seed: AGREEYSAMR (NRAS Q61R)
  misc_feature (2)..(2): Xaa can be Thr, Tyr, Met, Phe, Trp, Ala, Ile, Leu, Gln, Ser, Val, or Gly
  misc_feature (10)..(10): Xaa can be Arg, or Lys
AXREEYSAMX

SEQ ID NO: 22579 - protein, 11 aa, Artificial Sequence
  Description of Artificial Sequence: Synthetic peptide
  Seed: DILDTAGREEY (NRAS Q61R)
  misc_feature (2)..(2): Xaa can be Val, Thr, Gln, Ala, Glu, Ile, Leu, Met, Pro, Ser, Gly, Phe, Cys, Asn, Asp, Trp, or Tyr
  misc_feature (11)..(11): Xaa can be Arg, Tyr, Lys, Phe, Trp, Leu, Met, or His
DXLDTAGREEX

SEQ ID NO: 22580 - protein, 10 aa, Artificial Sequence
  Description of Artificial Sequence: Synthetic peptide
  Seed: ILDTAGREEY (NRAS Q61R)
  misc_feature (2)..(2): Xaa can be Thr, Ala, Ser, Met, Phe, Ile, Val, Leu, Tyr, Trp, Gln, Gly, Asn, Cys, Pro, Asp, Glu, His, Lys, or Arg
  misc_feature (10)..(10): Xaa can be Tyr, Leu, Trp, Phe, Ile, Met, Lys, Val, Arg, Ala, Cys, His, Thr, or Gln
IXDTAGREEX

SEQ ID NO: 22581 - protein, 9 aa, Artificial Sequence
  Description of Artificial Sequence: Synthetic peptide
  Seed: LDTAGREEY (NRAS Q61R)
  misc_feature (2)..(2): Xaa can be Glu, Gln, Asp, Met, Ala, Ile, Ser, Val, Leu, Pro, Thr, Cys, Phe, Gly, Asn, Tyr, His, Lys, Arg, or Trp
  misc_feature (9)..(9): Xaa can be Tyr, Phe, Met, Leu, Trp, Lys, Ile, Val, His, or Cys
LXTAGREEX

SEQ ID NO: 22582 - protein, 11 aa, Artificial Sequence
  Description of Artificial Sequence: Synthetic peptide
  Seed: REEYSAMRDQY (NRAS Q61R)
  misc_feature (2)..(2): Xaa can be Glu, Asp, or Gln
  misc_feature (11)..(11): Xaa can be Trp, Phe, Leu, Met, or Tyr
RXEYSAMRDQX

SEQ ID NO: 22583 - protein, 10 aa, Artificial Sequence
  Description of Artificial Sequence: Synthetic peptide
  Seed: ISTRDPLSKI (PIK3CA E542K)
  misc_feature (2)..(2): Xaa can be Ser, Thr, Ala, Cys, Gly, Ile, Met, Val, Asp, Leu, Asn, Pro, or Gln
  misc_feature (10)..(10): Xaa can be Trp, Phe, Leu, Met, Tyr, or Ile
IXTRDPLSKX

SEQ ID NO: 22584 - protein, 9 aa, Artificial Sequence
  Description of Artificial Sequence: Synthetic peptide
  Seed: KITEQEKDF (PIK3CA E542K)
  misc_feature (2)..(2): Xaa can be Ala, Leu, Met, Gln, Ile, Ser, Thr, Val, Gly, Pro, Cys, Glu, or Asn
  misc_feature (9)..(9): Xaa can be Trp, Tyr, Phe, Ile, Leu, Met, Val, or His
KXTEQEKDX

SEQ ID NO: 22585 - protein, 10 aa, Artificial Sequence
  Description of Artificial Sequence: Synthetic peptide
  Seed: KITEQEKDFL (PIK3CA E542K)
  misc_feature (2)..(2): Xaa can be Gln, Met, Leu, Ile, or Val
  misc_feature (10)..(10): Xaa can be Phe, Trp, Leu, Ile, Met, Val, or Tyr
KXTEQEKDFX

SEQ ID NO: 22586 - protein, 11 aa, Artificial Sequence
  Description of Artificial Sequence: Synthetic peptide
  Seed: KITEQEKDFLW (PIK3CA E542K)
  misc_feature (2)..(2): Xaa can be Ser, Thr, Leu, Met, Gln, Ala, Val, Ile, Glu, Cys, Gly, Phe, Lys, Arg, Tyr, Asp, Asn, Pro, or Trp
  misc_feature (11)..(11): Xaa can be Trp, Phe, Leu, Tyr, Met, Ile, or Val
KXTEQEKDFLX

SEQ ID NO: 22587 - protein, 9 aa, Artificial Sequence
  Description of Artificial Sequence: Synthetic peptide
  Seed: LSKITEQEK (PIK3CA E542K)
  misc_feature (2)..(2): Xaa can be Thr, Ala, Ser, Val, Met, Ile, Leu, Gly, Gln, Cys, Phe, Tyr, Asp, Asn, or Glu
  misc_feature (9)..(9): Xaa can be Tyr, Lys, Phe, Met, Leu, Arg, Ile, Val, or Trp
LXKITEQEX

SEQ ID NO: 22588 - protein, 11 aa, Artificial Sequence
  Description of Artificial Sequence: Synthetic peptide
  Seed: LSKITEQEKDF (PIK3CA E542K)
  misc_feature (2)..(2): Xaa can be Ser, Thr, Ala, Cys, Gly, Ile, Leu, Met, Asn, Gln, or Val
  misc_feature (11)..(11): Xaa can be Trp, or Phe
LXKITEQEKDX

SEQ ID NO: 22589 - protein, 9 aa, Artificial Sequence
  Description of Artificial Sequence: Synthetic peptide
  Seed: STRDPLSKI (PIK3CA E542K)
  misc_feature (2)..(2): Xaa can be Ala, Thr, Val, Ser, Ile, Met, Gln, Leu, Gly, Arg, Phe, Tyr, Pro, Cys, Asn, Trp, Asp, Glu, His, or Lys
  misc_feature (9)..(9): Xaa can be Phe, Val, Lys, Leu, Tyr, Trp, Ile, Met, Arg, His, Ala, Cys, Thr, Gln, Gly, Ser, Pro, Asn, or Glu
SXRDPLSKX

SEQ ID NO: 22590 - protein, 10 aa, Artificial Sequence
  Description of Artificial Sequence: Synthetic peptide
  Seed: STRDPLSKIT (PIK3CA E542K)
  misc_feature (2)..(2): Xaa can be Thr, Ser, Val, Ala, Phe, Ile, Met, Tyr, Gly, Leu, Asn, Gln, or Trp
  misc_feature (10)..(10): Xaa can be Lys, Ala, Ile, Leu, Val, Met, Ser, Tyr, Gly, Arg, or Thr
SXRDPLSKIX

SEQ ID NO: 22591 - protein, 8 aa, Artificial Sequence
  Description of Artificial Sequence: Synthetic peptide
  Seed: TRDPLSKI (PIK3CA E542K)
  misc_feature (2)..(2): Xaa can be Tyr, Phe, Ala, His, Gln, Arg, Trp, Glu, Gly, Ile, Leu, Met, Asn, Ser, Thr, Val, Cys, Asp, Lys, or Pro
  misc_feature (8)..(8): Xaa can be Leu, Phe, Ile, Met, Val, Tyr, Cys, or Trp
TXDPLSKX

SEQ ID NO: 22592 - protein, 9 aa, Artificial Sequence
  Description of Artificial Sequence: Synthetic peptide
  Seed: TRDPLSKIT (PIK3CA E542K)
  misc_feature (2)..(2): Xaa can be Arg, Tyr, Phe, Ala, Gln, Trp, His, Ile, Met, Cys, Asp, Glu, Gly, Lys, Leu, Asn, Pro, Ser, Thr, or Val
  misc_feature (9)..(9): Xaa can be Phe, Ile, Leu, Met, Val, Cys, Ala, Tyr, Thr, Trp, Gly, Pro, or Ser
TXDPLSKIX

SEQ ID NO: 22593 - protein, 11 aa, Artificial Sequence
  Description of Artificial Sequence: Synthetic peptide
  Seed: EITKQEKDFLW (PIK3CA E545K)
  misc_feature (2)..(2): Xaa can be Ala, Ser, Thr, Phe, His, Lys, Leu, Met, Arg, Val, Trp, Tyr, Cys, Gly, Asn, or Ile
  misc_feature (11)..(11): Xaa can be Trp, or Phe
EXTKQEKDFLX

SEQ ID NO: 22594 - protein, 9 aa, Artificial Sequence
  Description of Artificial Sequence: Synthetic peptide
  Seed: ITKQEKDFL (PIK3CA E545K)
  misc_feature (2)..(2): Xaa can be Ala, Ser, Thr, Val, Ile, Cys, Gly, Met, Phe, Leu, Asn, Pro, or Gln
  misc_feature (9)..(9): Xaa can be Trp, Phe, Tyr, Met, Ile, Leu, or Val
IXKQEKDFX

SEQ ID NO: 22595 - protein, 10 aa, Artificial Sequence
  Description of Artificial Sequence: Synthetic peptide
  Seed: ITKQEKDFLW (PIK3CA E545K)
  misc_feature (2)..(2): Xaa can be Ser, Thr, Ala, Cys, Gly, Ile, Met, Val, Leu, Gln, Asp, Glu, Phe, Asn, Pro, or Trp
  misc_feature (10)..(10): Xaa can be Trp, Phe, Tyr, Leu, Ile, or Met
IXKQEKDFLX

SEQ ID NO: 22596 - protein, 11 aa, Artificial Sequence
  Description of Artificial Sequence: Synthetic peptide
  Seed: ITKQEKDFLWS (PIK3CA E545K)
  misc_feature (2)..(2): Xaa can be Thr, Ser, or Ala
  misc_feature (11)..(11): Xaa can be Trp, Phe, Met, Tyr, Ala, Cys, Asp, Glu, Gly, His, Ile, Lys, Leu, Asn, Pro, Gln, Arg, Thr, Val, or Ser
IXKQEKDFLWX

SEQ ID NO: 22597 - protein, 11 aa, Artificial Sequence
  Description of Artificial Sequence: Synthetic peptide
  Seed: KQEKDFLWSHR (PIK3CA E545K)
  misc_feature (2)..(2): Xaa can be Phe, Met, Tyr, Ala, Ile, Leu, Ser, Thr, Val, Trp, or Gln
  misc_feature (11)..(11): Xaa can be Arg, or Lys
KXEKDFLWSHX

SEQ ID NO: 22598 - protein, 9 aa, Artificial Sequence
  Description of Artificial Sequence: Synthetic peptide
  Seed: LSEITKQEK (PIK3CA E545K)
  misc_feature (2)..(2): Xaa can be Ser, Thr, Ala, Gly, Ile, Val, Leu, Met, Phe, Tyr, Asp, Glu, Asn, Gln, Trp, or Cys
  misc_feature (9)..(9): Xaa can be Tyr, Lys, Phe, Leu, Met, Arg, Ile, Val, Trp, or His
LXEITKQEX

SEQ ID NO: 22599 - protein, 9 aa, Artificial Sequence
  Description of Artificial Sequence: Synthetic peptide
  Seed: SEITKQEKD (PIK3CA E545K)
  misc_feature (2)..(2): Xaa can be Glu, Asp, or Gln
  misc_feature (9)..(9): Xaa can be Val, Ala, Cys, Ile, Leu, Met, Pro, Thr, Glu, Phe, Gly, Lys, Asn, Gln, Arg, Ser, Trp, Tyr, or Asp
SXITKQEKX

SEQ ID NO: 22600 - protein, 10 aa, Artificial Sequence
  Description of Artificial Sequence: Synthetic peptide
  Seed: SEITKQEKDF (PIK3CA E545K)
  misc_feature (2)..(2): Xaa can be Glu, Gln, or Asp
  misc_feature (10)..(10): Xaa can be Trp, Tyr, Phe, Ala, Cys, Ile, Leu, Met, Pro, Thr, or Val
SXITKQEKDX

SEQ ID NO: 22601 - protein, 11 aa, Artificial Sequence
  Description of Artificial Sequence: Synthetic peptide
  Seed: SEITKQEKDFL (PIK3CA E545K)
  misc_feature (2)..(2): Xaa can be Glu, Gln, or Asp
  misc_feature (11)..(11): Xaa can be Trp, Phe, Tyr, Ala, Cys, Ile, Met, Pro, Thr, Val, or Leu
SXITKQEKDFX

SEQ ID NO: 22602 - protein, 11 aa, Artificial Sequence
  Description of Artificial Sequence: Synthetic peptide
  Seed: TRDPLSEITKQ (PIK3CA E545K)
  misc_feature (2)..(2): Xaa can be Arg, Trp, Phe, Tyr, Glu, Gly, Lys, or Gln
  misc_feature (11)..(11): Xaa can be Lys, Phe, Leu, Met, His, Ile, Arg, Val, Trp, Tyr, or Gln
TXDPLSEITKX

SEQ ID NO: 22603 - protein, 10 aa, Artificial Sequence
  Description of Artificial Sequence: Synthetic peptide
  Seed: DARHGGWTTK (PIK3CA H1047R)
  misc_feature (2)..(2): Xaa can be Thr, Val, Ile, Ala, Ser, Leu, Met, Cys, Phe, Gly, Asn, Gln, Trp, Tyr, Asp, Glu, His, Lys, or Pro
  misc_feature (10)..(10): Xaa can be Arg, Lys, Tyr, Met, Phe, His, or Leu
DXRHGGWTTX

SEQ ID NO: 22604 - protein, 9 aa, Artificial Sequence
  Description of Artificial Sequence: Synthetic peptide
  Seed: KQMNDARHG (PIK3CA H1047R)
  misc_feature (2)..(2): Xaa can be Gln, Met, Lys, Ala, Glu, His, Leu, Arg, Val, Ile, Asn, Ser, Thr, Tyr, Phe, or Gly
  misc_feature (9)..(9): Xaa can be Phe, Tyr, Met, Leu, Ile, Val, Ala, His, Trp, Cys, or Gly
KXMNDARHX

SEQ ID NO: 22605 - protein, 11 aa, Artificial Sequence
  Description of Artificial Sequence: Synthetic peptide
  Seed: KQMNDARHGGW (PIK3CA H1047R)
  misc_feature (2)..(2): Xaa can be Arg, Glu, Gln, Leu, Met, Thr, Ile, Ser, Ala, Val, Cys, Asp, Phe, Gly, Lys, Trp, Tyr, Asn, His, or Pro
  misc_feature (11)..(11): Xaa can be Trp, Tyr, Phe, Leu, Met, Ile, Val, Cys, His, Ala, Lys, Gln, or Arg
KXMNDARHGGX

SEQ ID NO: 22606 - protein, 9 aa, Artificial Sequence
  Description of Artificial Sequence: Synthetic peptide
  Seed: MNDARHGGW (PIK3CA H1047R)
  misc_feature (2)..(2): Xaa can be Ser, Phe, Ala, Thr, Tyr, Cys, Gly, Val, Trp, Asp, Glu, Ile, Leu, Met, Pro, Gln, or Asn
  misc_feature (9)..(9): Xaa can be Trp, Phe, Leu, Tyr, Met, or Ile
MXDARHGGX

SEQ ID NO: 22607 - protein, 10 aa, Artificial Sequence
  Description of Artificial Sequence: Synthetic peptide
  Seed: QMNDARHGGW (PIK3CA H1047R)
  misc_feature (2)..(2): Xaa can be Gln, Thr, Val, Ile, Met, Ser, Ala, Cys, Asp, Glu, Phe, Gly, Leu, Asn, Pro, Trp, or Tyr
  misc_feature (10)..(10): Xaa can be Trp, Phe, Tyr, Ile, or Leu
QXNDARHGGX

SEQ ID NO: 22608 - protein, 9 aa, Artificial Sequence
  Description of Artificial Sequence: Synthetic peptide
  Seed: RHGGWTTKM (PIK3CA H1047R)
  misc_feature (2)..(2): Xaa can be Arg, Gln, His, Ala, Glu, Lys, Ser, Tyr, Met, Asn, Val, Phe, Gly, Ile, Leu, Thr, Trp, Pro, or Asp
  misc_feature (9)..(9): Xaa can be Leu, Tyr, Met, Phe, Ile, Val, Trp, His, Cys, Ala, Gly, Lys, Pro, Gln, Arg, Ser, or Thr
RXGGWTTKX

SEQ ID NO: 22609 - protein, 9 aa, Artificial Sequence
  Description of Artificial Sequence: Synthetic peptide
  Seed: DETRQLCDL (PIK3CA R88Q)
  misc_feature (2)..(2): Xaa can be , or Glu
  misc_feature (9)..(9): Xaa can be Ala, Phe, Ile, Met, Val, or Leu
DXTRQLCDX

SEQ ID NO: 22610 - protein, 10 aa, Artificial Sequence
  Description of Artificial Sequence: Synthetic peptide
  Seed: DETRQLCDLR (PIK3CA R88Q)
  misc_feature (2)..(2): Xaa can be Ala, Ile, Met, Ser, Thr, Val, Phe, Cys, Asp, Gly, His, Lys, Leu, Asn, Pro, Gln, Arg, Trp, Tyr, or Glu
  misc_feature (10)..(10): Xaa can be Arg, or Lys
DXTRQLCDLX

SEQ ID NO: 22611 - protein, 10 aa, Artificial Sequence
  Description of Artificial Sequence: Synthetic peptide
  Seed: EEFFDETRQL (PIK3CA R88Q)
  misc_feature (2)..(2): Xaa can be Glu, Gln, Asp, Ala, His, Lys, Asn, Arg, Ser, or Thr
  misc_feature (10)..(10): Xaa can be Trp, Phe, Tyr, Ala, Ile, Leu, Cys, Gly, His, Lys, Met, Pro, Arg, Ser, Thr, or Val
EXFFDETRQX

SEQ ID NO: 22612 - protein, 11 aa, Artificial Sequence
  Description of Artificial Sequence: Synthetic peptide
  Seed: EEFFDETRQLC (PIK3CA R88Q)
  misc_feature (2)..(2): Xaa can be Glu, Asp, or Gln
  misc_feature (11)..(11): Xaa can be Trp, Phe, Tyr, Ala, His, Ile, Leu, Met, Pro, Thr, Val, or Cys
EXFFDETRQLX

SEQ ID NO: 22613 - protein, 9 aa, Artificial Sequence
  Description of Artificial Sequence: Synthetic peptide
  Seed: EFFDETRQL (PIK3CA R88Q)
  misc_feature (2)..(2): Xaa can be Arg, Ala, Tyr, Phe, Ile, Leu, Met, Gln, Ser, Thr, Val, Trp, Glu, Gly, His, Asn, Cys, Asp, Lys, or Pro
  misc_feature (9)..(9): Xaa can be Leu, Tyr, Met, Lys, Phe, Ile, Arg, Val, Trp, Ala, His, or Cys
EXFDETRQX

SEQ ID NO: 22614 - protein, 9 aa, Artificial Sequence
  Description of Artificial Sequence: Synthetic peptide
  Seed: ETRQLCDLR (PIK3CA R88Q)
  misc_feature (2)..(2): Xaa can be Val, Thr, Ile, Ala, Met, Ser, Phe, Gly, Leu, Asn, Trp, Tyr, Gln, Cys, Asp, Glu, His, Lys, or Pro
  misc_feature (9)..(9): Xaa can be Arg, Lys, Tyr, His, Leu, Met, or Phe
EXRQLCDLX

SEQ ID NO: 22615 - protein, 11 aa, Artificial Sequence
  Description of Artificial Sequence: Synthetic peptide
  Seed: ETRQLCDLRLF (PIK3CA R88Q)
  misc_feature (2)..(2): Xaa can be Ser, Thr, Ala, Cys, Gly, Ile, Leu, Met, Asn, Gln, or Val
  misc_feature (11)..(11): Xaa can be Trp, or Phe
EXRQLCDLRLX

SEQ ID NO: 22616 - protein, 8 aa, Artificial Sequence
  Description of Artificial Sequence: Synthetic peptide
  Seed: FFDETRQL (PIK3CA R88Q)
  misc_feature (2)..(2): Xaa can be Ala, Ser, Phe, Tyr, Ile, Thr, Val, Met, Gly, Leu, Asn, Gln, Trp, Cys, Pro, Asp, Glu, His, Lys, or Arg
  misc_feature (8)..(8): Xaa can be Leu, Met, Phe, Tyr, Ile, Val, Trp, Ala, Cys, Lys, Arg, Thr, Gln, His, Ser, Pro, or Glu
FXDETRQX

SEQ ID NO: 22617 - protein, 9 aa, Artificial Sequence
  Description of Artificial Sequence: Synthetic peptide
  Seed: FFDETRQLC (PIK3CA R88Q)
  misc_feature (2)..(2): Xaa can be Phe, Tyr, Ala, Ile, Leu, Ser, Thr, Val, Trp, Met, Gly, Pro, Gln, Arg, His, Asn, Cys, Asp, Glu, or Lys
  misc_feature (9)..(9): Xaa can be Leu, Met, Cys, Phe, Ile, Lys, Val, Trp, Tyr, Ala, Arg, Thr, Ser, His, Pro, Gln, Gly, Glu, Asn, or Asp
FXDETRQLX

SEQ ID NO: 22618 - protein, 11 aa, Artificial Sequence
  Description of Artificial Sequence: Synthetic peptide
  Seed: FFDETRQLCDL (PIK3CA R88Q)
  misc_feature (2)..(2): Xaa can be Ala, Ile, Phe, Gly, Leu, Met, Ser, Thr, Val, Trp, Tyr, Cys, Asn, Pro, Gln, Arg, Glu, His, or Asp
  misc_feature (11)..(11): Xaa can be Leu, Met, Phe, Ile, Val, Tyr, Cys, Trp, or Ala
FXDETRQLCDX

SEQ ID NO: 22619 - protein, 11 aa, Artificial Sequence
  Description of Artificial Sequence: Synthetic peptide
  Seed: QLCDLRLFQPF (PIK3CA R88Q)
  misc_feature (2)..(2): Xaa can be Met, Gln, or Leu
  misc_feature (11)..(11): Xaa can be Tyr, Phe, or Met
QXCDLRLFQPX

SEQ ID NO: 22620 - protein, 11 aa, Artificial Sequence
  Description of Artificial Sequence: Synthetic peptide
  Seed: REEFFDETRQL (PIK3CA R88Q)
  misc_feature (2)..(2): Xaa can be Glu, Asp, Gln, His, or Lys
  misc_feature (11)..(11): Xaa can be Trp, Met, Phe, Leu, Tyr, Ile, Val, Ala, Cys, Gly, His, Pro, Ser, or Thr
RXEFFDETRQX

SEQ ID NO: 22621 - protein, 9 aa, Artificial Sequence
  Description of Artificial Sequence: Synthetic peptide
  Seed: TRQLCDLRL (PIK3CA R88Q)
  misc_feature (2)..(2): Xaa can be Arg, His, Gln, Tyr, Phe, Ala, Leu, or Met
  misc_feature (9)..(9): Xaa can be Leu, Phe, Met, Ile, Val, Tyr, Trp, Lys, Arg, Cys, or His
TXQLCDLRX

SEQ ID NO: 22622 - protein, 10 aa, Artificial Sequence
  Description of Artificial Sequence: Synthetic peptide
  Seed: TRQLCDLRLF (PIK3CA R88Q)
  misc_feature (2)..(2): Xaa can be Arg, Met, Gln, Ala, Cys, Asp, Glu, Phe, Gly, His, Ile, Lys, Leu, Asn, Pro, Ser, Thr, Val, Trp, or Tyr
  misc_feature (10)..(10): Xaa can be Phe, Tyr, Met, Ile, Lys, Leu, Arg, Val, or Trp
TXQLCDLRLX

SEQ ID NO: 22623 - protein, 9 aa, Artificial Sequence
  Description of Artificial Sequence: Synthetic peptide
  Seed: AGKGGTGVM (PTEN R130G)
  misc_feature (2)..(2): Xaa can be Ala, Pro, Ser, Thr, Val, Ile, Leu, Arg, Gly, Gln, Met, Glu, Tyr, Cys, Phe, Asn, Asp, His, Lys, or Trp
  misc_feature (9)..(9): Xaa can be Leu, Tyr, Met, Phe, Ile, Val, His, Trp, Lys, Ala, Cys, Arg, Gln, Thr, Ser, Pro, Glu, Gly, or Asn
AXKGGTGVX

SEQ ID NO: 22624 - protein, 9 aa, Artificial Sequence
  Description of Artificial Sequence: Synthetic peptide
  Seed: GTGVMICAY (PTEN R130G)
  misc_feature (2)..(2): Xaa can be Ala, Ser, Thr, Gln, Met, Leu, Val, Phe, Gly, Ile, Asn, Glu, Pro, Trp, Tyr, His, Lys, or Ar g
  misc_feature (9)..(9): Xaa can be Tyr, Phe, Met, Leu, Trp, Lys, His, Ile, or Val
GXGVMICAX

SEQ ID NO: 22625 - protein, 10 aa, Artificial Sequence
  Description of Artificial Sequence: Synthetic peptide
  Seed: GTGVMICAYL (PTEN R130G)
  misc_feature (2)..(2): Xaa can be Leu, Met, Ile, Gln, Thr, Val, Ala, or Ser
  misc_feature (10)..(10): Xaa can be Val, Leu, Ile, Ala, Met, or Thr
GXGVMICAYX

SEQ ID NO: 22626 - protein, 9 aa, Artificial Sequence
  Description of Artificial Sequence: Synthetic peptide
  Seed: KAGKGGTGV (PTEN R130G)
  misc_feature (2)..(2): Xaa can be Ala, Val, Ile, Met, Leu, Ser, Thr, Gly, Gln, Arg, Glu, Phe, Tyr, Cys, His, Asn, or Pro
  misc_feature (9)..(9): Xaa can be Leu, Met, Tyr, Phe, Val, Ile, Ala, His, Lys, Arg, or Trp
KXGKGGTGX

SEQ ID NO: 22627 - protein, 10 aa, Artificial Sequence
  Description of Artificial Sequence: Synthetic peptide
  Seed: KAGKGGTGVM (PTEN R130G)
  misc_feature (2)..(2): Xaa can be Ala, Ser, Val, Ile, Thr, Met, Leu, Glu, Gly, Gln, Cys, or Asn
  misc_feature (10)..(10): Xaa can be Tyr, Phe, Leu, Met, His, Ile, Lys, Arg, Val, or Trp
KXGKGGTGVX

SEQ ID NO: 22628 - protein, 11 aa, Artificial Sequence
  Description of Artificial Sequence: Synthetic peptide
  Seed: KAGKGGTGVMI (PTEN R130G)
  misc_feature (2)..(2): Xaa can be Thr, Ser, Ala, Ile, Val, Gln, Leu, Met, Glu, Gly, Cys, Asn, Asp, Phe, Pro, Trp, or Tyr
  misc_feature (11)..(11): Xaa can be Trp, Phe, Tyr, Leu, Met, Val, Ile, Lys, Arg, His, Cys, or Ala
KXGKGGTGVMX

SEQ ID NO: 22629 - protein, 11 aa, Artificial Sequence
  Description of Artificial Sequence: Synthetic peptide
  Seed: KGGTGVMICAY (PTEN R130G)
  misc_feature (2)..(2): Xaa can be Ala, Phe, Ile, Leu, Met, Asn, Gln, Ser, Thr, Val, Trp, Tyr, or Gly
  misc_feature (11)..(11): Xaa can be , or Tyr
KXGTGVMICAX

SEQ ID NO: 22630 - protein, 9 aa, Artificial Sequence
  Description of Artificial Sequence: Synthetic peptide
  Seed: AGKGQTGVM (PTEN R130Q)
  misc_feature (2)..(2): Xaa can be Ala, Ser, Ile, Val, Gln, Thr, Gly, Leu, Met, Glu, Arg, Asn, Tyr, Cys, Asp, Phe, His, Pro, Lys, or Trp
  misc_feature (9)..(9): Xaa can be Phe, Tyr, Leu, Met, Ile, His, Val, Trp, Ala, Lys, Cys, Arg, Gly, Pro, Gln, Ser, or Thr
AXKGQTGVX

SEQ ID NO: 22631 - protein, 9 aa, Artificial Sequence
  Description of Artificial Sequence: Synthetic peptide
  Seed: KAGKGQTGV (PTEN R130Q)
  misc_feature (2)..(2): Xaa can be Ala, Gln, Val, Ile, Ser, Thr, Leu, Met, Glu, or Gly
  misc_feature (9)..(9): Xaa can be Val, Ile, Tyr, Leu, Phe, Met, Ala, or His
KXGKGQTGX

SEQ ID NO: 22632 - protein, 10 aa, Artificial Sequence
  Description of Artificial Sequence: Synthetic peptide
  Seed: KAGKGQTGVM (PTEN R130Q)
  misc_feature (2)..(2): Xaa can be Ala, Ser, Thr, Val, Ile, Met, Gln, Glu, Gly, or Leu
  misc_feature (10)..(10): Xaa can be Tyr, Phe, Met, Leu, or His
KXGKGQTGVX

SEQ ID NO: 22633 - protein, 11 aa, Artificial Sequence
  Description of Artificial Sequence: Synthetic peptide
  Seed: KAGKGQTGVMI (PTEN R130Q)
  misc_feature (2)..(2): Xaa can be Ala, Thr, or Ser
  misc_feature (11)..(11): Xaa can be Leu, Met, or Ile
KXGKGQTGVMX

SEQ ID NO: 22634 - protein, 11 aa, Artificial Sequence
  Description of Artificial Sequence: Synthetic peptide
  Seed: KGQTGVMICAY (PTEN R130Q)
  misc_feature (2)..(2): Xaa can be Met, Thr, Val, Ala, Phe, His, Ile, Lys, Leu, Asn, Gln, Arg, Ser, Trp, Tyr, or Gly
  misc_feature (11)..(11): Xaa can be Tyr, or Phe
KXQTGVMICAX

SEQ ID NO: 22635 - protein, 9 aa, Artificial Sequence
  Description of Artificial Sequence: Synthetic peptide
  Seed: QTGVMICAY (PTEN R130Q)
  misc_feature (2)..(2): Xaa can be Ala, Thr, Val, Ser, Gln, Met, Ile, Leu, Gly, Glu, Asn, Pro, Phe, Cys, Asp, Trp, Tyr, His, Lys, or Arg
  misc_feature (9)..(9): Xaa can be Tyr, Lys, Arg, Phe, Met, Trp, Leu, His, Ile, or Val
QXGVMICAX

SEQ ID NO: 22636 - protein, 10 aa, Artificial Sequence
  Description of Artificial Sequence: Synthetic peptide
  Seed: QTGVMICAYL (PTEN R130Q)
  misc_feature (2)..(2): Xaa can be Thr, Ser, Ala, Gln, Val, Met, Leu, Ile, or Asn
  misc_feature (10)..(10): Xaa can be Val, Leu, Ala, Ile, Met, or Thr
QXGVMICAYX

SEQ ID NO: 22637 - protein, 11 aa, Artificial Sequence
  Description of Artificial Sequence: Synthetic peptide
  Seed: EVVRRCPHRER (TP53 H179R)
  misc_feature (2)..(2): Xaa can be Thr, Val, Phe, Ile, Leu, Met, Ser, Tyr, Ala, or Trp
  misc_feature (11)..(11): Xaa can be Arg, or Lys
EXVRRCPHREX

SEQ ID NO: 22638 - protein, 10 aa, Artificial Sequence
  Description of Artificial Sequence: Synthetic peptide
  Seed: RERCSDSDGL (TP53 H179R)
  misc_feature (2)..(2): Xaa can be Glu, Asp, or Gln
  misc_feature (10)..(10): Xaa can be Trp, Phe, Ile, Met, Val, Ala, Cys, Pro, Thr, Tyr, or Leu
RXRCSDSDGX

SEQ ID NO: 22639 - protein, 11 aa, Artificial Sequence
  Description of Artificial Sequence: Synthetic peptide
  Seed: RERCSDSDGLA (TP53 H179R)
  misc_feature (2)..(2): Xaa can be , or Glu
  misc_feature (11)..(11): Xaa can be Cys, Phe, Ile, Leu, Met, Pro, Thr, Val, or Ala
RXRCSDSDGLX

SEQ ID NO: 22640 - protein, 8 aa, Artificial Sequence
  Description of Artificial Sequence: Synthetic peptide
  Seed: RRCPHRER (TP53 H179R)
  misc_feature (2)..(2): Xaa can be , or Arg
  misc_feature (8)..(8): Xaa can be Phe, Ile, Lys, Leu, Met, Val, Trp, Tyr, or Arg
RXCPHREX

SEQ ID NO: 22641 - protein, 9 aa, Artificial Sequence
  Description of Artificial Sequence: Synthetic peptide
  Seed: RRCPHRERC (TP53 H179R)
  misc_feature (2)..(2): Xaa can be Arg, Gln, Lys, Glu, Gly, Asn, Ala, His, Met, Ser, Asp, Phe, Ile, Leu, Thr, Val, Tyr, Pro, Trp, or Cys
  misc_feature (9)..(9): Xaa can be Leu, Phe, Met, Tyr, Ile, Val, Lys, Arg, Trp, Ala, Cys, His, Glu, Gly, Asn, Pro, Gln, Ser, or Thr
RXCPHRERX

SEQ ID NO: 22642 - protein, 9 aa, Artificial Sequence
  Description of Artificial Sequence: Synthetic peptide
  Seed: VRRCPHRER (TP53 H179R)
  misc_feature (2)..(2): Xaa can be Arg, Gly, or Gln
  misc_feature (9)..(9): Xaa can be Leu, Phe, Ile, Lys, Met, Val, Tyr, or Arg
VXRCPHREX

SEQ ID NO: 22643 - protein, 10 aa, Artificial Sequence
  Description of Artificial Sequence: Synthetic peptide
  Seed: VVRRCPHRER (TP53 H179R)
  misc_feature (2)..(2): Xaa can be Met, Phe, Leu, Trp, Tyr, Val, Ala, Ile, Gln, Ser, or Thr
  misc_feature (10)..(10): Xaa can be Arg, or Lys
VXRRCPHREX

SEQ ID NO: 22644 - protein, 9 aa, Artificial Sequence
  Description of Artificial Sequence: Synthetic peptide
  Seed: GTRVLAMAI (TP53 R158L)
  misc_feature (2)..(2): Xaa can be Thr, Ser, Ala, Val, Ile, Met, Tyr, Gly, Gln, Phe, Trp, Asn, Cys, His, or Leu
  misc_feature (9)..(9): Xaa can be Lys, Ala, Val, Ile, Tyr, Met, Leu, Arg, Phe, Ser, Trp, Gly, His, Cys, Asn, Pro, Gln, or Th r
GXRVLAMAX

SEQ ID NO: 22645 - protein, 10 aa, Artificial Sequence
  Description of Artificial Sequence: Synthetic peptide
  Seed: GTRVLAMAIY (TP53 R158L)
  misc_feature (2)..(2): Xaa can be Ser, Thr, Gln, Ala, Met, Val, Ile, Leu, Tyr, Phe, Gly, Asn, or Trp
  misc_feature (10)..(10): Xaa can be Tyr, Lys, Phe, Ala, Met, Trp, Leu, Ile, Ser, or Val
GXRVLAMAIX

SEQ ID NO: 22646 - protein, 11 aa, Artificial Sequence
  Description of Artificial Sequence: Synthetic peptide
  Seed: GTRVLAMAIYK (TP53 R158L)
  misc_feature (2)..(2): Xaa can be Thr, Ser, Ala, Cys, Asp, Glu, Phe, Gly, His, Ile, Lys, Leu, Met, Asn, Pro, Gln, Arg, Val, Trp, or Tyr
  misc_feature (11)..(11): Xaa can be Lys, Arg, Ala, or Val
GXRVLAMAIYX

SEQ ID NO: 22647 - protein, 9 aa, Artificial Sequence
  Description of Artificial Sequence: Synthetic peptide
  Seed: PPGTRVLAM (TP53 R158L)
  misc_feature (2)..(2): Xaa can be Pro, Ala, Met, Leu, Ile, Gln, Val, Phe, Ser, Gly, His, Asn, Arg, Thr, or Tyr
  misc_feature (9)..(9): Xaa can be Leu, Met, Ile, Val, Ala, Phe, Cys, or Pro
PXGTRVLAX

SEQ ID NO: 22648 - protein, 9 aa, Artificial Sequence
  Description of Artificial Sequence: Synthetic peptide
  Seed: PPPGTRVLA (TP53 R158L)
  misc_feature (2)..(2): Xaa can be Pro, or Ala
  misc_feature (9)..(9): Xaa can be Ala, Leu, Met, Phe, Ile, Pro, or Val
PXPGTRVLX

SEQ ID NO: 22649 - protein, 10 aa, Artificial Sequence
  Description of Artificial Sequence: Synthetic peptide
  Seed: PPPGTRVLAM (TP53 R158L)
  misc_feature (2)..(2): Xaa can be Pro, or Ala
  misc_feature (10)..(10): Xaa can be Ala, Leu, Met, Phe, Ile, Pro, or Val
PXPGTRVLAX

SEQ ID NO: 22650 - protein, 8 aa, Artificial Sequence
  Description of Artificial Sequence: Synthetic peptide
  Seed: RVLAMAIY (TP53 R158L)
  misc_feature (2)..(2): Xaa can be Gln, Met, Glu, Lys, Ala, His, Ile, Leu, Ser, Thr, Val, Phe, Asn, Arg, Trp, or Tyr
  misc_feature (8)..(8): Xaa can be Tyr, Phe, Met, Leu, Ile, Val, or Trp
RXLAMAIX

SEQ ID NO: 22651 - protein, 9 aa, Artificial Sequence
  Description of Artificial Sequence: Synthetic peptide
  Seed: RVLAMAIYK (TP53 R158L)
  misc_feature (2)..(2): Xaa can be Thr, Met, Val, Ser, Tyr, Ile, Ala, Phe, Trp, Leu, Gln, Gly, Asn, Cys, Asp, Glu, His, Lys, Pro, or Arg
  misc_feature (9)..(9): Xaa can be Lys, Arg, Tyr, Phe, Ala, His, Val, Ile, Leu, Met, Trp, Ser, Gly, Gln, Thr, Asn, or Pro
RXLAMAIYX

SEQ ID NO: 22652 - protein, 10 aa, Artificial Sequence
  Description of Artificial Sequence: Synthetic peptide
  Seed: RVLAMAIYKQ (TP53 R158L)
  misc_feature (2)..(2): Xaa can be Ala, Phe, Ile, Leu, Met, Gln, Ser, Thr, Val, Trp, Tyr, Cys, Asp, Glu, Gly, His, Lys, Asn, Pro, or Arg
  misc_feature (10)..(10): Xaa can be Lys, Arg, Ala, Cys, Asp, Glu, Phe, Gly, His, Ile, Leu, Met, Asn, Pro, Gln, Ser, Thr, Val, Trp, or Tyr
RXLAMAIYKX

SEQ ID NO: 22653 - protein, 10 aa, Artificial Sequence
  Description of Artificial Sequence: Synthetic peptide
  Seed: TPPPGTRVLA (TP53 R158L)
  misc_feature (2)..(2): Xaa can be Pro, Ala, Val, Ser, or Met
  misc_feature (10)..(10): Xaa can be Leu, Ile, Val, Ala, Cys, Met, Phe, Gly, Lys, Pro, Arg, Ser, Thr, Trp, or Tyr
TXPPGTRVLX

SEQ ID NO: 22654 - protein, 11 aa, Artificial Sequence
  Description of Artificial Sequence: Synthetic peptide
  Seed: TPPPGTRVLAM (TP53 R158L)
  misc_feature (2)..(2): Xaa can be Pro, Ala, Val, Ser, Ile, Leu, Met, Arg, Tyr, Cys, Gly, Gln, Thr, Phe, Glu, His, Asn, Trp, Asp, or Lys
  misc_feature (11)..(11): Xaa can be Met, Leu, Phe, Ile, Val, Cys, Tyr, Ala, Lys, Trp, Gly, Pro, Arg, Ser, or Thr
TXPPGTRVLAX

SEQ ID NO: 22655 - protein, 8 aa, Artificial Sequence
  Description of Artificial Sequence: Synthetic peptide
  Seed: TRVLAMAI (TP53 R158L)
  misc_feature (2)..(2): Xaa can be His, Arg, or Gln
  misc_feature (8)..(8): Xaa can be Ala, Ile, Leu, Val, Cys, Phe, Met, Gly, Pro, Ser, or Thr
TXVLAMAX

SEQ ID NO: 22656 - protein, 9 aa, Artificial Sequence
  Description of Artificial Sequence: Synthetic peptide
  Seed: TRVLAMAIY (TP53 R158L)
  misc_feature (2)..(2): Xaa can be Arg, Gln, Lys, Met, His, Tyr, Ala, Glu, Leu, Ser, Val, Gly, Ile, Asn, Thr, Phe, Pro, or Cy s
  misc_feature (9)..(9): Xaa can be Tyr, Phe, Met, Leu, Ile, His, Val, Trp, Ala, Lys, or Arg
TXVLAMAIX

SEQ ID NO: 22657 - protein, 10 aa, Artificial Sequence
  Description of Artificial Sequence: Synthetic peptide
  Seed: TRVLAMAIYK (TP53 R158L)
  misc_feature (2)..(2): Xaa can be Arg, Met, Ala, Cys, Asp, Glu, Phe, Gly, His, Ile, Lys, Leu, Asn, Pro, Gln, Ser, Thr, Val, Trp, or Tyr
  misc_feature (10)..(10): Xaa can be Lys, Arg, Tyr, Phe, Ile, Leu, Met, or Val
TXVLAMAIYX

SEQ ID NO: 22658 - protein, 9 aa, Artificial Sequence
  Description of Artificial Sequence: Synthetic peptide
  Seed: EVVRHCPHH (TP53 R175H)
  misc_feature (2)..(2): Xaa can be Val, Ile, Thr, Ala, Leu, Ser, Met, Cys, Asp, Glu, Phe, Gly, Asn, Pro, Gln, or Tyr
  misc_feature (9)..(9): Xaa can be Arg, Lys, His, Leu, Met, Tyr, Phe, Val, Ile, or Ala
EXVRHCPHX

SEQ ID NO: 22659 - protein, 11 aa, Artificial Sequence
  Description of Artificial Sequence: Synthetic peptide
  Seed: EVVRHCPHHER (TP53 R175H)
  misc_feature (2)..(2): Xaa can be Thr, Val, Ala, Phe, Ile, Leu, Met, Ser, Tyr, His, Lys, Asn, Arg, Trp, Gly, or Gln
  misc_feature (11)..(11): Xaa can be Arg, or Lys
EXVRHCPHHEX

SEQ ID NO: 22660 - protein, 9 aa, Artificial Sequence
  Description of Artificial Sequence: Synthetic peptide
  Seed: HMTEVVRHC (TP53 R175H)
  misc_feature (2)..(2): Xaa can be Gln, Leu, Met, Ile, Thr, Val, Ala, Glu, Ser, Asn, Asp, Gly, His, Lys, Phe, or Pro
  misc_feature (9)..(9): Xaa can be Val, Ile, Leu, Phe, Trp, Met, Ala, Cys, Thr, or Tyr
HXTEVVRHX

SEQ ID NO: 22661 - protein, 10 aa, Artificial Sequence
  Description of Artificial Sequence: Synthetic peptide
  Seed: QHMTEVVRHC (TP53 R175H)
  misc_feature (2)..(2): Xaa can be , or His
  misc_feature (10)..(10): Xaa can be Leu, Ala, Phe, Ile, Met, Val, Trp, or Cys
QXMTEVVRHX

SEQ ID NO: 22662 - protein, 8 aa, Artificial Sequence
  Description of Artificial Sequence: Synthetic peptide
  Seed: TEVVRHCP (TP53 R175H)
  misc_feature (2)..(2): Xaa can be Glu, or Asp
  misc_feature (8)..(8): Xaa can be Leu, Val, Ala, Cys, Phe, Ile, Met, Thr, or Pro
TXVVRHCX

SEQ ID NO: 22663 - protein, 9 aa, Artificial Sequence
  Description of Artificial Sequence: Synthetic peptide
  Seed: TEVVRHCPH (TP53 R175H)
  misc_feature (2)..(2): Xaa can be Glu, or Asp
  misc_feature (9)..(9): Xaa can be Tyr, Phe, Ile, Leu, Met, Val, Trp, or His
TXVVRHCPX

SEQ ID NO: 22664 - protein, 9 aa, Artificial Sequence
  Description of Artificial Sequence: Synthetic peptide
  Seed: VRHCPHHER (TP53 R175H)
  misc_feature (2)..(2): Xaa can be Arg, Phe, Tyr, Ala, Trp, Thr, Val, Gly, Ile, Leu, Met, Asn, Gln, Ser, His, Lys, Pro, Cys, Glu, or Asp
  misc_feature (9)..(9): Xaa can be Arg, Phe, Tyr, Leu, Met, Lys, Ile, Val, Trp, Ala, or His
VXHCPHHEX

SEQ ID NO: 22665 - protein, 10 aa, Artificial Sequence
  Description of Artificial Sequence: Synthetic peptide
  Seed: VVRHCPHHER (TP53 R175H)
  misc_feature (2)..(2): Xaa can be Met, Thr, Val, Ala, Phe, Ile, Leu, Gln, Ser, Trp, Tyr, Gly, Asn, or Asp
  misc_feature (10)..(10): Xaa can be Arg, or Lys
VXRHCPHHEX

SEQ ID NO: 22666 - protein, 9 aa, Artificial Sequence
  Description of Artificial Sequence: Synthetic peptide
  Seed: GGMNQRPIL (TP53 R248Q)
  misc_feature (2)..(2): Xaa can be Arg, Gln, Gly, Glu, Ala, His, Lys, Asn, Cys, Asp, Ile, Leu, Met, Ser, Thr, Val, or Tyr
  misc_feature (9)..(9): Xaa can be Leu, Lys, Met, Phe, Ile, Arg, Val, Tyr, Ala, Cys, Glu, Gly, His, Asn, Pro, Gln, Ser, Thr, or Trp
GXMNQRPIX

SEQ ID NO: 22667 - protein, 8 aa, Artificial Sequence
  Description of Artificial Sequence: Synthetic peptide
  Seed: GMNQRPIL (TP53 R248Q)
  misc_feature (2)..(2): Xaa can be Pro, Ala, Ile, Leu, or Met
  misc_feature (8)..(8): Xaa can be Leu, Ile, or Met
GXNQRPIX

SEQ ID NO: 22668 - protein, 10 aa, Artificial Sequence
  Description of Artificial Sequence: Synthetic peptide
  Seed: GMNQRPILTI (TP53 R248Q)
  misc_feature (2)..(2): Xaa can be Arg, Gln, Leu, Met, Gly, Ile, Glu, Lys, Val, Asn, Ala, Ser, Thr, Cys, Asp, or Pro
  misc_feature (10)..(10): Xaa can be Leu, Phe, Ile, Val, Lys, Trp, Ala, Met, Arg, Tyr, Cys, Glu, Gly, His, Asn, Gln, Ser, or Th r
GXNQRPILTX

SEQ ID NO: 22669 - protein, 11 aa, Artificial Sequence
  Description of Artificial Sequence: Synthetic peptide
  Seed: GMNQRPILTII (TP53 R248Q)
  misc_feature (2)..(2): Xaa can be Met, or Leu
  misc_feature (11)..(11): Xaa can be Ile, Leu, Val, or Ala
GXNQRPILTIX

SEQ ID NO: 22670 - protein, 10 aa, Artificial Sequence
  Description of Artificial Sequence: Synthetic peptide
  Seed: MGGMNQRPIL (TP53 R248Q)
  misc_feature (2)..(2): Xaa can be Arg, Gly, Thr, Ala, Ile, Leu, Met, Asn, Gln, Ser, or Val
  misc_feature (10)..(10): Xaa can be Leu, Phe, Ile, Lys, Met, Arg, or Tyr
MXGMNQRPIX

SEQ ID NO: 22671 - protein, 9 aa, Artificial Sequence
  Description of Artificial Sequence: Synthetic peptide
  Seed: MNQRPILTI (TP53 R248Q)
  misc_feature (2)..(2): Xaa can be Arg, Ala, Gln, Ser, Thr, Gly, Val, Glu, Ile, Leu, Met, Asp, Lys, Asn, Pro, Cys, His, Tyr, Phe, or Trp
  misc_feature (9)..(9): Xaa can be Leu, Val, Phe, Ile, Met, Trp, Tyr, Lys, Arg, Ala, Cys, His, Thr, Pro, Glu, Gly, Asn, Gln, or Ser
MXQRPILTX

SEQ ID NO: 22672 - protein, 10 aa, Artificial Sequence
  Description of Artificial Sequence: Synthetic peptide
  Seed: MNQRPILTII (TP53 R248Q)
  misc_feature (2)..(2): Xaa can be Met, Leu, Ile, Gln, Ser, Thr, Val, Ala, Cys, Asp, Glu, Phe, Gly, His, Lys, Asn, Pro, Arg, Trp, or Tyr
  misc_feature (10)..(10): Xaa can be Tyr, Met, Phe, His, Ile, Leu, Val, Trp, Ala, Ser, Thr, Cys, or Pro
MXQRPILTIX

SEQ ID NO: 22673 - protein, 11 aa, Artificial Sequence
  Description of Artificial Sequence: Synthetic peptide
  Seed: NSSCMGGMNQR (TP53 R248Q)
  misc_feature (2)..(2): Xaa can be Thr, Ala, Phe, Ile, Met, Ser, Val, Tyr, Gly, Leu, Asn, Gln, Trp, Glu, Lys, Arg, or Cys
  misc_feature (11)..(11): Xaa can be Arg, Lys, or Tyr
NXSCMGGMNQX

SEQ ID NO: 22674 - protein, 8 aa, Artificial Sequence
  Description of Artificial Sequence: Synthetic peptide
  Seed: QRPILTII (TP53 R248Q)
  misc_feature (2)..(2): Xaa can be Arg, His, or Gln
  misc_feature (8)..(8): Xaa can be Leu, Met, or Ile
QXPILTIX

SEQ ID NO: 22675 - protein, 9 aa, Artificial Sequence
  Description of Artificial Sequence: Synthetic peptide
  Seed: QRPILTIIT (TP53 R248Q)
  misc_feature (2)..(2): Xaa can be His, Arg, Gln, or Pro
  misc_feature (9)..(9): Xaa can be Ala, Ile, Leu, Val, Cys, Pro, Thr, or Met
QXPILTIIX

SEQ ID NO: 22676 - protein, 10 aa, Artificial Sequence
  Description of Artificial Sequence: Synthetic peptide
  Seed: QRPILTIITL (TP53 R248Q)
  misc_feature (2)..(2): Xaa can be Arg, Tyr, Phe, Met, His, Trp, Ile, Leu, Ser, Ala, Cys, Asp, Glu, Gly, Lys, Asn, Pro, Gln, Thr, or Val
  misc_feature (10)..(10): Xaa can be Phe, Leu, Met, Val, Ile, Ala, Tyr, Lys, Arg, or Trp
QXPILTIITX

SEQ ID NO: 22677 - protein, 9 aa, Artificial Sequence
  Description of Artificial Sequence: Synthetic peptide
  Seed: SCMGGMNQR (TP53 R248Q)
  misc_feature (2)..(2): Xaa can be Val, Ala, Thr, Leu, Met, Ile, Ser, Gly, Gln, Phe, Cys, Asn, Pro, Tyr, His, Trp, Asp, Glu, Lys, or Arg
  misc_feature (9)..(9): Xaa can be Arg, Lys, Met, Leu, Tyr, Phe, Ile, Val, His, Ala, Trp, Gln, or Cys
SXMGGMNQX

SEQ ID NO: 22678 - protein, 10 aa, Artificial Sequence
  Description of Artificial Sequence: Synthetic peptide
  Seed: SSCMGGMNQR (TP53 R248Q)
  misc_feature (2)..(2): Xaa can be Thr, Ala, Ser, Val, Phe, Gly, Ile, Leu, Met, Asn, Gln, Trp, Tyr, Asp, Glu, Cys, His, or Pr o
  misc_feature (10)..(10): Xaa can be Arg, Lys, Tyr, Leu, Met, Phe, or His
SXCMGGMNQX

SEQ ID NO: 22679 - protein, 10 aa, Artificial Sequence
  Description of Artificial Sequence: Synthetic peptide
  Seed: CMGGMNWRPI (TP53 R248W)
  misc_feature (2)..(2): Xaa can be Leu, Met, Ile, Gln, Thr, or Val
  misc_feature (10)..(10): Xaa can be Val, Ile, Ala, Leu, or Met
CXGGMNWRPX

SEQ ID NO: 22680 - protein, 11 aa, Artificial Sequence
  Description of Artificial Sequence: Synthetic peptide
  Seed: CMGGMNWRPIL (TP53 R248W)
  misc_feature (2)..(2): Xaa can be Leu, or Met
  misc_feature (11)..(11): Xaa can be Leu, Val, or Ile
CXGGMNWRPIX

SEQ ID NO: 22681 - protein, 9 aa, Artificial Sequence
  Description of Artificial Sequence: Synthetic peptide
  Seed: GMNWRPILT (TP53 R248W)
  misc_feature (2)..(2): Xaa can be Leu, Met, Ile, Gln, Thr, or Val
  misc_feature (9)..(9): Xaa can be Val, Ile, Leu, Ala, Cys, Met, or Thr
GXNWRPILX

SEQ ID NO: 22682 - protein, 10 aa, Artificial Sequence
  Description of Artificial Sequence: Synthetic peptide
  Seed: GMNWRPILTI (TP53 R248W)
  misc_feature (2)..(2): Xaa can be Met, Leu, Ile, Gln, Thr, or Val
  misc_feature (10)..(10): Xaa can be Val, Ile, Leu, Phe, Trp, Ala, Cys, Met, or Thr
GXNWRPILTX

SEQ ID NO: 22683 - protein, 11 aa, Artificial Sequence
  Description of Artificial Sequence: Synthetic peptide
  Seed: GMNWRPILTII (TP53 R248W)
  misc_feature (2)..(2): Xaa can be Leu, or Met
  misc_feature (11)..(11): Xaa can be Ala, Ile, Leu, or Val
GXNWRPILTIX

SEQ ID NO: 22684 - protein, 10 aa, Artificial Sequence
  Description of Artificial Sequence: Synthetic peptide
  Seed: MGGMNWRPIL (TP53 R248W)
  misc_feature (2)..(2): Xaa can be Arg, or Gly
  misc_feature (10)..(10): Xaa can be Leu, Phe, Lys, Met, Arg, or Tyr
MXGMNWRPIX

SEQ ID NO: 22685 - protein, 9 aa, Artificial Sequence
  Description of Artificial Sequence: Synthetic peptide
  Seed: MNWRPILTI (TP53 R248W)
  misc_feature (2)..(2): Xaa can be Gln, Arg, Met, Ser, Leu, Lys, Ala, Thr, Glu, Gly, Ile, Val, His, Asn, Asp, Pro, Tyr, Cys, Phe, or Trp
  misc_feature (9)..(9): Xaa can be Val, Tyr, Leu, Met, Phe, Trp, Ile, His, Ala, Lys, Cys, Thr, Arg, Gly, Ser, Pro, Asn, Glu, or Gln
MXWRPILTX

SEQ ID NO: 22686 - protein, 11 aa, Artificial Sequence
  Description of Artificial Sequence: Synthetic peptide
  Seed: NSSCMGGMNWR (TP53 R248W)
  misc_feature (2)..(2): Xaa can be Ala, Ile, Leu, Met, Ser, Thr, Val, Tyr, Gly, Gln, Phe, Lys, Arg, or Trp
  misc_feature (11)..(11): Xaa can be Arg, or Lys
NXSCMGGMNWX

SEQ ID NO: 22687 - protein, 9 aa, Artificial Sequence
  Description of Artificial Sequence: Synthetic peptide
  Seed: SCMGGMNWR (TP53 R248W)
  misc_feature (2)..(2): Xaa can be Leu, Met, Thr, Val, Ile, Ala, Ser, Gln, Phe, Gly, Asn, Pro, Trp, Tyr, Cys, Asp, Glu, His, Lys, or Arg
  misc_feature (9)..(9): Xaa can be Arg, Lys, Tyr, His, Leu, Met, Val, Phe, Ala, Ile, or Gln
SXMGGMNWX

SEQ ID NO: 22688 - protein, 10 aa, Artificial Sequence
  Description of Artificial Sequence: Synthetic peptide
  Seed: SSCMGGMNWR (TP53 R248W)
  misc_feature (2)..(2): Xaa can be Val, Thr, Ile, Ser, Ala, Phe, Gly, Leu, Met, Asn, Gln, Trp, Tyr, Cys, Glu, His, Lys, or Ar g
  misc_feature (10)..(10): Xaa can be Arg, Lys, or Tyr
SXCMGGMNWX

SEQ ID NO: 22689 - protein, 10 aa, Artificial Sequence
  Description of Artificial Sequence: Synthetic peptide
  Seed: WRPILTIITL (TP53 R248W)
  misc_feature (2)..(2): Xaa can be Arg, Met, Ala, Cys, Asp, Glu, Phe, Gly, His, Ile, Lys, Leu, Asn, Pro, Gln, Ser, Thr, Val, Trp, or Tyr
  misc_feature (10)..(10): Xaa can be Ala, Phe, Ile, Leu, Met, Val, Tyr, His, Lys, or Arg
WXPILTIITX

SEQ ID NO: 22690 - protein, 10 aa, Artificial Sequence
  Description of Artificial Sequence: Synthetic peptide
  Seed: CVCACPGRDR (TP53 R273C)
  misc_feature (2)..(2): Xaa can be Ile, Leu, Met, Ser, Thr, Ala, Val, Phe, Gln, Tyr, or Trp
  misc_feature (10)..(10): Xaa can be Arg, or Lys
CXCACPGRDX

SEQ ID NO: 22691 - protein, 11 aa, Artificial Sequence
  Description of Artificial Sequence: Synthetic peptide
  Seed: CVCACPGRDRR (TP53 R273C)
  misc_feature (2)..(2): Xaa can be Thr, Tyr, or Val
  misc_feature (11)..(11): Xaa can be , or Arg
CXCACPGRDRX

SEQ ID NO: 22692 - protein, 10 aa, Artificial Sequence
  Description of Artificial Sequence: Synthetic peptide
  Seed: EVCVCACPGR (TP53 R273C)
  misc_feature (2)..(2): Xaa can be Thr, Val, Ile, Tyr, Ala, Phe, Leu, Met, Ser, Trp, Cys, Glu, Gly, Asn, Gln, or His
  misc_feature (10)..(10): Xaa can be Arg, Lys, or Tyr
EXCVCACPGX

SEQ ID NO: 22693 - protein, 8 aa, Artificial Sequence
  Description of Artificial Sequence: Synthetic peptide
  Seed: FEVCVCAC (TP53 R273C)
  misc_feature (2)..(2): Xaa can be , or Glu
  misc_feature (8)..(8): Xaa can be Ala, Phe, Ile, Leu, Met, Pro, Thr, Val, or Cys
FXVCVCAX

SEQ ID NO: 22694 - protein, 9 aa, Artificial Sequence
  Description of Artificial Sequence: Synthetic peptide
  Seed: FEVCVCACP (TP53 R273C)
  misc_feature (2)..(2): Xaa can be , or Glu
  misc_feature (9)..(9): Xaa can be Ala, Ile, Leu, Val, Cys, Phe, Met, Ser, Thr, or Pro
FXVCVCACX

SEQ ID NO: 22695 - protein, 9 aa, Artificial Sequence
  Description of Artificial Sequence: Synthetic peptide
  Seed: GRNSFEVCV (TP53 R273C)
  misc_feature (2)..(2): Xaa can be Arg, His, Gln, Ala, Phe, Tyr, Lys, Glu, Ser, Gly, Ile, Leu, Met, Asn, Thr, Val, or Trp
  misc_feature (9)..(9): Xaa can be Leu, Met, Phe, Tyr, Ile, Ala, Val, Cys, Pro, Thr, Lys, His, Gln, Arg, or Trp
GXNSFEVCX

SEQ ID NO: 22696 - protein, 10 aa, Artificial Sequence
  Description of Artificial Sequence: Synthetic peptide
  Seed: GRNSFEVCVC (TP53 R273C)
  misc_feature (2)..(2): Xaa can be , or Arg
  misc_feature (10)..(10): Xaa can be Ala, Phe, Ile, Leu, Met, Pro, Arg, Val, Trp, Tyr, or Cys
GXNSFEVCVX

SEQ ID NO: 22697 - protein, 11 aa, Artificial Sequence
  Description of Artificial Sequence: Synthetic peptide
  Seed: GRNSFEVCVCA (TP53 R273C)
  misc_feature (2)..(2): Xaa can be , or Arg
  misc_feature (11)..(11): Xaa can be , or Ala
GXNSFEVCVCX

SEQ ID NO: 22698 - protein, 11 aa, Artificial Sequence
  Description of Artificial Sequence: Synthetic peptide
  Seed: LLGRNSFEVCV (TP53 R273C)
  misc_feature (2)..(2): Xaa can be Leu, or Met
  misc_feature (11)..(11): Xaa can be Ile, Leu, or Val
LXGRNSFEVCX

SEQ ID NO: 22699 - protein, 9 aa, Artificial Sequence
  Description of Artificial Sequence: Synthetic peptide
  Seed: NSFEVCVCA (TP53 R273C)
  misc_feature (2)..(2): Xaa can be Thr, Val, Ser, Ala, Ile, Met, Leu, Gly, Asn, or Gln
  misc_feature (9)..(9): Xaa can be Val, Ile, Leu, Ala, Met, Thr, or Ser
NXFEVCVCX

SEQ ID NO: 22700 - protein, 9 aa, Artificial Sequence
  Description of Artificial Sequence: Synthetic peptide
  Seed: SFEVCVCAC (TP53 R273C)
  misc_feature (2)..(2): Xaa can be Phe, Tyr, Trp, Ala, Leu, Met, Gly, Ile, Ser, Thr, or Val
  misc_feature (9)..(9): Xaa can be Leu, Met, Phe, Ile, Val, Cys, or Tyr
SXEVCVCAX

SEQ ID NO: 22701 - protein, 10 aa, Artificial Sequence
  Description of Artificial Sequence: Synthetic peptide
  Seed: SFEVCVCACP (TP53 R273C)
  misc_feature (2)..(2): Xaa can be Glu, Ala, Cys, Asp, Phe, Gly, His, Ile, Lys, Leu, Met, Asn, Pro, Gln, Arg, Ser, Thr, Val, Trp, or Tyr
  misc_feature (10)..(10): Xaa can be Ala, Pro, Val, Ile, or Thr
SXEVCVCACX

SEQ ID NO: 22702 - protein, 10 aa, Artificial Sequence
  Description of Artificial Sequence: Synthetic peptide
  Seed: EVHVCACPGR (TP53 R273H)
  misc_feature (2)..(2): Xaa can be Val, Thr, Ile, Phe, Tyr, Ala, Leu, Met, Ser, Trp, Cys, Gly, Asn, or Gln
  misc_feature (10)..(10): Xaa can be Arg, Lys, or Tyr
EXHVCACPGX

SEQ ID NO: 22703 - protein, 8 aa, Artificial Sequence
  Description of Artificial Sequence: Synthetic peptide
  Seed: FEVHVCAC (TP53 R273H)
  misc_feature (2)..(2): Xaa can be Glu, or Asp
  misc_feature (8)..(8): Xaa can be Leu, Ala, Phe, Ile, Met, Pro, Ser, Thr, Val, or Cys
FXVHVCAX

SEQ ID NO: 22704 - protein, 9 aa, Artificial Sequence
  Description of Artificial Sequence: Synthetic peptide
  Seed: FEVHVCACP (TP53 R273H)
  misc_feature (2)..(2): Xaa can be Glu, or Asp
  misc_feature (9)..(9): Xaa can be Ala, Val, Ile, Cys, Phe, Gly, Leu, Met, Ser, Thr, or Pro
FXVHVCACX

SEQ ID NO: 22705 - protein, 9 aa, Artificial Sequence
  Description of Artificial Sequence: Synthetic peptide
  Seed: GRNSFEVHV (TP53 R273H)
  misc_feature (2)..(2): Xaa can be Arg, His, Gln, Ala, Tyr, Glu, Phe, Asn, Gly, Lys, Met, Ser, Trp, Leu, Asp, Ile, Thr, Val, or Pro
  misc_feature (9)..(9): Xaa can be Leu, Met, Phe, Tyr, Ile, Val, Ala, Lys, Arg, Cys, Pro, Thr, His, Gln, or Trp
GXNSFEVHX

SEQ ID NO: 22706 - protein, 10 aa, Artificial Sequence
  Description of Artificial Sequence: Synthetic peptide
  Seed: GRNSFEVHVC (TP53 R273H)
  misc_feature (2)..(2): Xaa can be Arg, or Gln
  misc_feature (10)..(10): Xaa can be Leu, Tyr, Ala, Phe, His, Ile, Lys, Met, Pro, Gln, Arg, Thr, Val, Trp, or Cys
GXNSFEVHVX

SEQ ID NO: 22707 - protein, 11 aa, Artificial Sequence
  Description of Artificial Sequence: Synthetic peptide
  Seed: GRNSFEVHVCA (TP53 R273H)
  misc_feature (2)..(2): Xaa can be , or Arg
  misc_feature (11)..(11): Xaa can be , or Ala
GXNSFEVHVCX

SEQ ID NO: 22708 - protein, 8 aa, Artificial Sequence
  Description of Artificial Sequence: Synthetic peptide
  Seed: HVCACPGR (TP53 R273H)
  misc_feature (2)..(2): Xaa can be , or Val
  misc_feature (8)..(8): Xaa can be , or Arg
HXCACPGX

SEQ ID NO: 22709 - protein, 10 aa, Artificial Sequence
  Description of Artificial Sequence: Synthetic peptide
  Seed: HVCACPGRDR (TP53 R273H)
  misc_feature (2)..(2): Xaa can be Ala, Thr, Val, Ile, Leu, Met, Gln, Ser, Tyr, Gly, Phe, or Trp
  misc_feature (10)..(10): Xaa can be Arg, Lys, Tyr, Phe, Leu, or Met
HXCACPGRDX

SEQ ID NO: 22710 - protein, 11 aa, Artificial Sequence
  Description of Artificial Sequence: Synthetic peptide
  Seed: HVCACPGRDRR (TP53 R273H)
  misc_feature (2)..(2): Xaa can be Ala, Ile, Leu, Met, Ser, Thr, Val, Tyr, Phe, or Trp
  misc_feature (11)..(11): Xaa can be Arg, or Lys
HXCACPGRDRX

SEQ ID NO: 22711 - protein, 11 aa, Artificial Sequence
  Description of Artificial Sequence: Synthetic peptide
  Seed: LLGRNSFEVHV (TP53 R273H)
  misc_feature (2)..(2): Xaa can be Met, or Leu
  misc_feature (11)..(11): Xaa can be Val, Ile, or Leu
LXGRNSFEVHX

SEQ ID NO: 22712 - protein, 9 aa, Artificial Sequence
  Description of Artificial Sequence: Synthetic peptide
  Seed: NSFEVHVCA (TP53 R273H)
  misc_feature (2)..(2): Xaa can be Pro, Thr, Val, Ala, Ile, Ser, Leu, Met, Gly, Asn, Cys, Phe, or Gln
  misc_feature (9)..(9): Xaa can be Val, Ala, Ile, Leu, Met, Thr, Cys, Ser, Phe, Pro, Glu, Gly, His, Lys, Asn, Gln, Arg, or Ty r
NXFEVHVCX

SEQ ID NO: 22713 - protein, 9 aa, Artificial Sequence
  Description of Artificial Sequence: Synthetic peptide
  Seed: SFEVHVCAC (TP53 R273H)
  misc_feature (2)..(2): Xaa can be Tyr, Phe, Arg, Trp, Ala, Asp, Glu, Gly, His, Ile, Lys, Leu, Met, Asn, Gln, Ser, Thr, Val, Cys, or Pro
  misc_feature (9)..(9): Xaa can be Leu, Phe, Met, Ile, Val, Tyr, Cys, Ala, or Trp
SXEVHVCAX

SEQ ID NO: 22714 - protein, 9 aa, Artificial Sequence
  Description of Artificial Sequence: Synthetic peptide
  Seed: CACPGRDWR (TP53 R282W)
  misc_feature (2)..(2): Xaa can be Thr, Phe, Ile, Leu, Met, Gln, Ser, Val, Trp, Tyr, Ala, Gly, or Asn
  misc_feature (9)..(9): Xaa can be Arg, or Lys
CXCPGRDWX

SEQ ID NO: 22715 - protein, 11 aa, Artificial Sequence
  Description of Artificial Sequence: Synthetic peptide
  Seed: GRDWRTEEENL (TP53 R282W)
  misc_feature (2)..(2): Xaa can be Arg, or Tyr
  misc_feature (11)..(11): Xaa can be Leu, Phe, Ile, Lys, Met, Arg, Val, Trp, or Tyr
GXDWRTEEENX

SEQ ID NO: 22716 - protein, 10 aa, Artificial Sequence
  Description of Artificial Sequence: Synthetic peptide
  Seed: RDWRTEEENL (TP53 R282W)
  misc_feature (2)..(2): Xaa can be Glu, Asp, or Gln
  misc_feature (10)..(10): Xaa can be Leu, Phe, Met, Ala, Cys, Ile, Pro, Thr, Val, Trp, or Tyr
RXWRTEEENX

SEQ ID NO: 22717 - protein, 11 aa, Artificial Sequence
  Description of Artificial Sequence: Synthetic peptide
  Seed: RVCACPGRDWR (TP53 R282W)
  misc_feature (2)..(2): Xaa can be Met, Phe, Ile, Leu, Thr, Val, Tyr, Ala, Gly, Asn, Gln, Ser, or Trp
  misc_feature (11)..(11): Xaa can be Arg, or Lys
RXCACPGRDWX

SEQ ID NO: 22718 - protein, 9 aa, Artificial Sequence
  Description of Artificial Sequence: Synthetic peptide
  Seed: WRTEEENLR (TP53 R282W)
  misc_feature (2)..(2): Xaa can be , or Arg
  misc_feature (9)..(9): Xaa can be Phe, His, Ile, Lys, Leu, Met, Val, Trp, Tyr, or Arg
WXTEEENLX

SEQ ID NO: 22719 - protein, 10 aa, Artificial Sequence
  Description of Artificial Sequence: Synthetic peptide
  Seed: WRTEEENLRK (TP53 R282W)
  misc_feature (2)..(2): Xaa can be , or Arg
  misc_feature (10)..(10): Xaa can be Phe, Ile, Leu, Met, Arg, Trp, Tyr, or Lys
WXTEEENLRX

SEQ ID NO: 22720 - protein, 11 aa, Artificial Sequence
  Description of Artificial Sequence: Synthetic peptide
  Seed: WRTEEENLRKK (TP53 R282W)
  misc_feature (2)..(2): Xaa can be , or Arg
  misc_feature (11)..(11): Xaa can be Phe, His, Ile, Leu, Met, Arg, Val, Trp, Tyr, or Lys
WXTEEENLRKX

SEQ ID NO: 22721 - protein, 10 aa, Artificial Sequence
  Description of Artificial Sequence: Synthetic peptide
  Seed: CEPPEVGSDC (TP53 Y220C)
  misc_feature (2)..(2): Xaa can be , or Glu
  misc_feature (10)..(10): Xaa can be Ala, Phe, Ile, Leu, Met, Pro, Ser, Thr, Val, or Cys
CXPPEVGSDX

SEQ ID NO: 22722 - protein, 11 aa, Artificial Sequence
  Description of Artificial Sequence: Synthetic peptide
  Seed: CEPPEVGSDCT (TP53 Y220C)
  misc_feature (2)..(2): Xaa can be , or Glu
  misc_feature (11)..(11): Xaa can be Ala, Cys, Phe, Gly, Ile, Leu, Met, Pro, Ser, Val, or Thr
CXPPEVGSDCX

SEQ ID NO: 22723 - protein, 8 aa, Artificial Sequence
  Description of Artificial Sequence: Synthetic peptide
  Seed: VPCEPPEV (TP53 Y220C)
  misc_feature (2)..(2): Xaa can be Pro, Ala, Ile, Gln, Ser, Thr, Val, Phe, Gly, Leu, Met, Asp, Glu, Asn, Tyr, His, Lys, Cys, or Trp
  misc_feature (8)..(8): Xaa can be Ile, Leu, Val, Met, Phe, Ala, Tyr, Cys, Gly, Pro, Ser, Thr, or Trp
VXCEPPEX

SEQ ID NO: 22724 - protein, 9 aa, Artificial Sequence
  Description of Artificial Sequence: Synthetic peptide
  Seed: VPCEPPEVG (TP53 Y220C)
  misc_feature (2)..(2): Xaa can be Pro, Ala, Val, Gly, Ile, Ser, Thr, Cys, Leu, Met, Asp, Phe, Gln, Tyr, Glu, or Asn
  misc_feature (9)..(9): Xaa can be Tyr, Phe, Met, Ala, Leu, Ile, Val, Trp, Cys, His, Pro, Thr, Glu, Lys, Asn, Gln, Arg, Ser, or Gly
VXCEPPEVX

SEQ ID NO: 22725 - protein, 10 aa, Artificial Sequence
  Description of Artificial Sequence: Synthetic peptide
  Seed: VPCEPPEVGS (TP53 Y220C)
  misc_feature (2)..(2): Xaa can be Pro, or Ala
  misc_feature (10)..(10): Xaa can be Ala, Leu, Met, Cys, Phe, Gly, Ile, Lys, Pro, Arg, Thr, Val, Trp, Tyr, or Ser
VXCEPPEVGX

SEQ ID NO: 22726 - protein, 9 aa, Artificial Sequence
  Description of Artificial Sequence: Synthetic peptide
  Seed: VVPCEPPEV (TP53 Y220C)
  misc_feature (2)..(2): Xaa can be Met, Ala, Leu, Ile, Thr, Val, Ser, Gln, Phe, Pro, Tyr, Glu, Gly, Asn, Arg, Trp, Cys, Asp, His, or Lys
  misc_feature (9)..(9): Xaa can be Leu, Met, Phe, Val, Ile, Tyr, Lys, Arg, Ala, Cys, His, Trp, or Thr
VXPCEPPEX

SEQ ID NO: 22727 - protein, 10 aa, Artificial Sequence
  Description of Artificial Sequence: Synthetic peptide
  Seed: VVVPCEPPEV (TP53 Y220C)
  misc_feature (2)..(2): Xaa can be Leu, Gln, Met, Ile, Val, Ala, Ser, Thr, Glu, Gly, Cys, or Asn
  misc_feature (10)..(10): Xaa can be Leu, Val, Ile, Met, Phe, Ala, Cys, Thr, or Trp
VXVPCEPPEX

SEQ ID NO: 22728 - protein, 15 aa, Homo sapiens
  Native (AKT1 E17K)
AIVKEGWLHKRGKYI

SEQ ID NO: 22729 - protein, 16 aa, Homo sapiens
  Native (AKT1 E17K)
AIVKEGWLHKRGKYIK

SEQ ID NO: 22730 - protein, 17 aa, Homo sapiens
  Native (AKT1 E17K)
AIVKEGWLHKRGKYIKT

SEQ ID NO: 22731 - protein, 19 aa, Homo sapiens
  Native (AKT1 E17K)
AIVKEGWLHKRGKYIKTWR

SEQ ID NO: 22732 - protein, 20 aa, Homo sapiens
  Native (AKT1 E17K)
AIVKEGWLHKRGKYIKTWRP

SEQ ID NO: 22733 - protein, 21 aa, Homo sapiens
  Native (AKT1 E17K)
AIVKEGWLHKRGKYIKTWRPR

SEQ ID NO: 22734 - protein, 22 aa, Homo sapiens
  Native (AKT1 E17K)
AIVKEGWLHKRGKYIKTWRPRY

SEQ ID NO: 22735 - protein, 23 aa, Homo sapiens
  Native (AKT1 E17K)
AIVKEGWLHKRGKYIKTWRPRYF

SEQ ID NO: 22736 - protein, 24 aa, Homo sapiens
  Native (AKT1 E17K)
AIVKEGWLHKRGKYIKTWRPRYFL

SEQ ID NO: 22737 - protein, 25 aa, Homo sapiens
  Native (AKT1 E17K)
AIVKEGWLHKRGKYIKTWRPRYFLL

SEQ ID NO: 22738 - protein, 19 aa, Homo sapiens
  Native (AKT1 E17K)
DVAIVKEGWLHKRGKYIKT

SEQ ID NO: 22739 - protein, 20 aa, Homo sapiens
  Native (AKT1 E17K)
DVAIVKEGWLHKRGKYIKTW

SEQ ID NO: 22740 - protein, 21 aa, Homo sapiens
  Native (AKT1 E17K)
DVAIVKEGWLHKRGKYIKTWR

SEQ ID NO: 22741 - protein, 22 aa, Homo sapiens
  Native (AKT1 E17K)
DVAIVKEGWLHKRGKYIKTWRP

SEQ ID NO: 22742 - protein, 23 aa, Homo sapiens
  Native (AKT1 E17K)
DVAIVKEGWLHKRGKYIKTWRPR

SEQ ID NO: 22743 - protein, 24 aa, Homo sapiens
  Native (AKT1 E17K)
DVAIVKEGWLHKRGKYIKTWRPRY

SEQ ID NO: 22744 - protein, 25 aa, Homo sapiens
  Native (AKT1 E17K)
DVAIVKEGWLHKRGKYIKTWRPRYF

SEQ ID NO: 22745 - protein, 15 aa, Homo sapiens
  Native (AKT1 E17K)
EGWLHKRGKYIKTWR

SEQ ID NO: 22746 - protein, 16 aa, Homo sapiens
  Native (AKT1 E17K)
EGWLHKRGKYIKTWRP

SEQ ID NO: 22747 - protein, 17 aa, Homo sapiens
  Native (AKT1 E17K)
EGWLHKRGKYIKTWRPR

SEQ ID NO: 22748 - protein, 19 aa, Homo sapiens
  Native (AKT1 E17K)
EGWLHKRGKYIKTWRPRYF

SEQ ID NO: 22749 - protein, 20 aa, Homo sapiens
  Native (AKT1 E17K)
EGWLHKRGKYIKTWRPRYFL

SEQ ID NO: 22750 - protein, 21 aa, Homo sapiens
  Native (AKT1 E17K)
EGWLHKRGKYIKTWRPRYFLL

SEQ ID NO: 22751 - protein, 22 aa, Homo sapiens
  Native (AKT1 E17K)
EGWLHKRGKYIKTWRPRYFLLK

SEQ ID NO: 22752 - protein, 23 aa, Homo sapiens
  Native (AKT1 E17K)
EGWLHKRGKYIKTWRPRYFLLKN

SEQ ID NO: 22753 - protein, 24 aa, Homo sapiens
  Native (AKT1 E17K)
EGWLHKRGKYIKTWRPRYFLLKND

SEQ ID NO: 22754 - protein, 25 aa, Homo sapiens
  Native (AKT1 E17K)
EGWLHKRGKYIKTWRPRYFLLKNDG

SEQ ID NO: 22755 - protein, 15 aa, Homo sapiens
  Native (AKT1 E17K)
GWLHKRGKYIKTWRP

SEQ ID NO: 22756 - protein, 16 aa, Homo sapiens
  Native (AKT1 E17K)
GWLHKRGKYIKTWRPR

SEQ ID NO: 22757 - protein, 17 aa, Homo sapiens
  Native (AKT1 E17K)
GWLHKRGKYIKTWRPRY

SEQ ID NO: 22758 - protein, 19 aa, Homo sapiens
  Native (AKT1 E17K)
GWLHKRGKYIKTWRPRYFL

SEQ ID NO: 22759 - protein, 20 aa, Homo sapiens
  Native (AKT1 E17K)
GWLHKRGKYIKTWRPRYFLL

SEQ ID NO: 22760 - protein, 21 aa, Homo sapiens
  Native (AKT1 E17K)
GWLHKRGKYIKTWRPRYFLLK

SEQ ID NO: 22761 - protein, 22 aa, Homo sapiens
  Native (AKT1 E17K)
GWLHKRGKYIKTWRPRYFLLKN

SEQ ID NO: 22762 - protein, 23 aa, Homo sapiens
  Native (AKT1 E17K)
GWLHKRGKYIKTWRPRYFLLKND

SEQ ID NO: 22763 - protein, 24 aa, Homo sapiens
  Native (AKT1 E17K)
GWLHKRGKYIKTWRPRYFLLKNDG

SEQ ID NO: 22764 - protein, 14 aa, Homo sapiens
  Native (AKT1 E17K)
HKRGKYIKTWRPRY

SEQ ID NO: 22765 - protein, 15 aa, Homo sapiens
  Native (AKT1 E17K)
HKRGKYIKTWRPRYF

SEQ ID NO: 22766 - protein, 16 aa, Homo sapiens
  Native (AKT1 E17K)
HKRGKYIKTWRPRYFL

SEQ ID NO: 22767 - protein, 17 aa, Homo sapiens
  Native (AKT1 E17K)
HKRGKYIKTWRPRYFLL

SEQ ID NO: 22768 - protein, 14 aa, Homo sapiens
  Native (AKT1 E17K)
IVKEGWLHKRGKYI

SEQ ID NO: 22769 - protein, 15 aa, Homo sapiens
  Native (AKT1 E17K)
IVKEGWLHKRGKYIK

SEQ ID NO: 22770 - protein, 16 aa, Homo sapiens
  Native (AKT1 E17K)
IVKEGWLHKRGKYIKT

SEQ ID NO: 22771 - protein, 17 aa, Homo sapiens
  Native (AKT1 E17K)
IVKEGWLHKRGKYIKTW

SEQ ID NO: 22772 - protein, 19 aa, Homo sapiens
  Native (AKT1 E17K)
IVKEGWLHKRGKYIKTWRP

SEQ ID NO: 22773 - protein, 20 aa, Homo sapiens
  Native (AKT1 E17K)
IVKEGWLHKRGKYIKTWRPR

SEQ ID NO: 22774 - protein, 21 aa, Homo sapiens
  Native (AKT1 E17K)
IVKEGWLHKRGKYIKTWRPRY

SEQ ID NO: 22775 - protein, 22 aa, Homo sapiens
  Native (AKT1 E17K)
IVKEGWLHKRGKYIKTWRPRYF

SEQ ID NO: 22776 - protein, 23 aa, Homo sapiens
  Native (AKT1 E17K)
IVKEGWLHKRGKYIKTWRPRYFL

SEQ ID NO: 22777 - protein, 24 aa, Homo sapiens
  Native (AKT1 E17K)
IVKEGWLHKRGKYIKTWRPRYFLL

SEQ ID NO: 22778 - protein, 25 aa, Homo sapiens
  Native (AKT1 E17K)
IVKEGWLHKRGKYIKTWRPRYFLLK

SEQ ID NO: 22779 - protein, 14 aa, Homo sapiens
  Native (AKT1 E17K)
KEGWLHKRGKYIKT

SEQ ID NO: 22780 - protein, 15 aa, Homo sapiens
  Native (AKT1 E17K)
KEGWLHKRGKYIKTW

SEQ ID NO: 22781 - protein, 16 aa, Homo sapiens
  Native (AKT1 E17K)
KEGWLHKRGKYIKTWR

SEQ ID NO: 22782 - protein, 17 aa, Homo sapiens
  Native (AKT1 E17K)
KEGWLHKRGKYIKTWRP

SEQ ID NO: 22783 - protein, 19 aa, Homo sapiens
  Native (AKT1 E17K)
KEGWLHKRGKYIKTWRPRY

SEQ ID NO: 22784 - protein, 20 aa, Homo sapiens
  Native (AKT1 E17K)
KEGWLHKRGKYIKTWRPRYF

SEQ ID NO: 22785 - protein, 21 aa, Homo sapiens
  Native (AKT1 E17K)
KEGWLHKRGKYIKTWRPRYFL

SEQ ID NO: 22786 - protein, 22 aa, Homo sapiens
  Native (AKT1 E17K)
KEGWLHKRGKYIKTWRPRYFLL

SEQ ID NO: 22787 - protein, 23 aa, Homo sapiens
  Native (AKT1 E17K)
KEGWLHKRGKYIKTWRPRYFLLK

SEQ ID NO: 22788 - protein, 24 aa, Homo sapiens
  Native (AKT1 E17K)
KEGWLHKRGKYIKTWRPRYFLLKN

SEQ ID NO: 22789 - protein, 25 aa, Homo sapiens
  Native (AKT1 E17K)
KEGWLHKRGKYIKTWRPRYFLLKND

SEQ ID NO: 22790 - protein, 14 aa, Homo sapiens
  Native (AKT1 E17K)
KRGKYIKTWRPRYF

SEQ ID NO: 22791 - protein, 15 aa, Homo sapiens
  Native (AKT1 E17K)
KRGKYIKTWRPRYFL

SEQ ID NO: 22792 - protein, 15 aa, Homo sapiens
  Native (AKT1 E17K)
LHKRGKYIKTWRPRY

SEQ ID NO: 22793 - protein, 16 aa, Homo sapiens
  Native (AKT1 E17K)
LHKRGKYIKTWRPRYF

SEQ ID NO: 22794 - protein, 17 aa, Homo sapiens
  Native (AKT1 E17K)
LHKRGKYIKTWRPRYFL

SEQ ID NO: 22795 - protein, 18 aa, Homo sapiens
  Native (AKT1 E17K)
LHKRGKYIKTWRPRYFLL

SEQ ID NO: 22796 - protein, 19 aa, Homo sapiens
  Native (AKT1 E17K)
LHKRGKYIKTWRPRYFLLK

SEQ ID NO: 22797 - protein, 20 aa, Homo sapiens
  Native (AKT1 E17K)
LHKRGKYIKTWRPRYFLLKN

SEQ ID NO: 22798 - protein, 22 aa, Homo sapiens
  Native (AKT1 E17K)
LHKRGKYIKTWRPRYFLLKNDG

SEQ ID NO: 22799 - protein, 20 aa, Homo sapiens
  Native (AKT1 E17K)
MSDVAIVKEGWLHKRGKYIK

SEQ ID NO: 22800 - protein, 21 aa, Homo sapiens
  Native (AKT1 E17K)
MSDVAIVKEGWLHKRGKYIKT

SEQ ID NO: 22801 - protein, 22 aa, Homo sapiens
  Native (AKT1 E17K)
MSDVAIVKEGWLHKRGKYIKTW

SEQ ID NO: 22802 - protein, 23 aa, Homo sapiens
  Native (AKT1 E17K)
MSDVAIVKEGWLHKRGKYIKTWR

SEQ ID NO: 22803 - protein, 24 aa, Homo sapiens
  Native (AKT1 E17K)
MSDVAIVKEGWLHKRGKYIKTWRP

SEQ ID NO: 22804 - protein, 25 aa, Homo sapiens
  Native (AKT1 E17K)
MSDVAIVKEGWLHKRGKYIKTWRPR

SEQ ID NO: 22805 - protein, 19 aa, Homo sapiens
  Native (AKT1 E17K)
SDVAIVKEGWLHKRGKYIK

SEQ ID NO: 22806 - protein, 20 aa, Homo sapiens
  Native (AKT1 E17K)
SDVAIVKEGWLHKRGKYIKT

SEQ ID NO: 22807 - protein, 21 aa, Homo sapiens
  Native (AKT1 E17K)
SDVAIVKEGWLHKRGKYIKTW

SEQ ID NO: 22808 - protein, 22 aa, Homo sapiens
  Native (AKT1 E17K)
SDVAIVKEGWLHKRGKYIKTWR

SEQ ID NO: 22809 - protein, 23 aa, Homo sapiens
  Native (AKT1 E17K)
SDVAIVKEGWLHKRGKYIKTWRP

SEQ ID NO: 22810 - protein, 24 aa, Homo sapiens
  Native (AKT1 E17K)
SDVAIVKEGWLHKRGKYIKTWRPR

SEQ ID NO: 22811 - protein, 25 aa, Homo sapiens
  Native (AKT1 E17K)
SDVAIVKEGWLHKRGKYIKTWRPRY

SEQ ID NO: 22812 - protein, 16 aa, Homo sapiens
  Native (AKT1 E17K)
VAIVKEGWLHKRGKYI

SEQ ID NO: 22813 - protein, 17 aa, Homo sapiens
  Native (AKT1 E17K)
VAIVKEGWLHKRGKYIK

SEQ ID NO: 22814 - protein, 19 aa, Homo sapiens
  Native (AKT1 E17K)
VAIVKEGWLHKRGKYIKTW

SEQ ID NO: 22815 - protein, 20 aa, Homo sapiens
  Native (AKT1 E17K)
VAIVKEGWLHKRGKYIKTWR

SEQ ID NO: 22816 - protein, 21 aa, Homo sapiens
  Native (AKT1 E17K)
VAIVKEGWLHKRGKYIKTWRP

SEQ ID NO: 22817 - protein, 22 aa, Homo sapiens
  Native (AKT1 E17K)
VAIVKEGWLHKRGKYIKTWRPR

SEQ ID NO: 22818 - protein, 23 aa, Homo sapiens
  Native (AKT1 E17K)
VAIVKEGWLHKRGKYIKTWRPRY

SEQ ID NO: 22819 - protein, 24 aa, Homo sapiens
  Native (AKT1 E17K)
VAIVKEGWLHKRGKYIKTWRPRYF

SEQ ID NO: 22820 - protein, 25 aa, Homo sapiens
  Native (AKT1 E17K)
VAIVKEGWLHKRGKYIKTWRPRYFL

SEQ ID NO: 22821 - protein, 14 aa, Homo sapiens
  Native (AKT1 E17K)
VKEGWLHKRGKYIK

SEQ ID NO: 22822 - protein, 15 aa, Homo sapiens
  Native (AKT1 E17K)
VKEGWLHKRGKYIKT

SEQ ID NO: 22823 - protein, 16 aa, Homo sapiens
  Native (AKT1 E17K)
VKEGWLHKRGKYIKTW

SEQ ID NO: 22824 - protein, 17 aa, Homo sapiens
  Native (AKT1 E17K)
VKEGWLHKRGKYIKTWR

SEQ ID NO: 22825 - protein, 19 aa, Homo sapiens
  Native (AKT1 E17K)
VKEGWLHKRGKYIKTWRPR

SEQ ID NO: 22826 - protein, 20 aa, Homo sapiens
  Native (AKT1 E17K)
VKEGWLHKRGKYIKTWRPRY

SEQ ID NO: 22827 - protein, 21 aa, Homo sapiens
  Native (AKT1 E17K)
VKEGWLHKRGKYIKTWRPRYF

SEQ ID NO: 22828 - protein, 22 aa, Homo sapiens
  Native (AKT1 E17K)
VKEGWLHKRGKYIKTWRPRYFL

SEQ ID NO: 22829 - protein, 23 aa, Homo sapiens
  Native (AKT1 E17K)
VKEGWLHKRGKYIKTWRPRYFLL

SEQ ID NO: 22830 - protein, 24 aa, Homo sapiens
  Native (AKT1 E17K)
VKEGWLHKRGKYIKTWRPRYFLLK

SEQ ID NO: 22831 - protein, 25 aa, Homo sapiens
  Native (AKT1 E17K)
VKEGWLHKRGKYIKTWRPRYFLLKN

SEQ ID NO: 22832 - protein, 15 aa, Homo sapiens
  Native (AKT1 E17K)
WLHKRGKYIKTWRPR

SEQ ID NO: 22833 - protein, 16 aa, Homo sapiens
  Native (AKT1 E17K)
WLHKRGKYIKTWRPRY

SEQ ID NO: 22834 - protein, 17 aa, Homo sapiens
  Native (AKT1 E17K)
WLHKRGKYIKTWRPRYF

SEQ ID NO: 22835 - protein, 19 aa, Homo sapiens
  Native (AKT1 E17K)
WLHKRGKYIKTWRPRYFLL

SEQ ID NO: 22836 - protein, 20 aa, Homo sapiens
  Native (AKT1 E17K)
WLHKRGKYIKTWRPRYFLLK

SEQ ID NO: 22837 - protein, 22 aa, Homo sapiens
  Native (AKT1 E17K)
WLHKRGKYIKTWRPRYFLLKND

SEQ ID NO: 22838 - protein, 23 aa, Homo sapiens
  Native (AKT1 E17K)
WLHKRGKYIKTWRPRYFLLKNDG

SEQ ID NO: 22839 - protein, 20 aa, Homo sapiens
  Native (BRAF V600E)
DLTVKIGDFGLATEKSRWSG

SEQ ID NO: 22840 - protein, 21 aa, Homo sapiens
  Native (BRAF V600E)
DLTVKIGDFGLATEKSRWSGS

SEQ ID NO: 22841 - protein, 22 aa, Homo sapiens
  Native (BRAF V600E)
DLTVKIGDFGLATEKSRWSGSH

SEQ ID NO: 22842 - protein, 20 aa, Homo sapiens
  Native (BRAF V600E)
EDLTVKIGDFGLATEKSRWS

SEQ ID NO: 22843 - protein, 21 aa, Homo sapiens
  Native (BRAF V600E)
EDLTVKIGDFGLATEKSRWSG

SEQ ID NO: 22844 - protein, 22 aa, Homo sapiens
  Native (BRAF V600E)
EDLTVKIGDFGLATEKSRWSGS

SEQ ID NO: 22845 - protein, 23 aa, Homo sapiens
  Native (BRAF V600E)
EDLTVKIGDFGLATEKSRWSGSH

SEQ ID NO: 22846 - protein, 24 aa, Homo sapiens
  Native (BRAF V600E)
EDLTVKIGDFGLATEKSRWSGSHQ

SEQ ID NO: 22847 - protein, 25 aa, Homo sapiens
  Native (BRAF V600E)
EDLTVKIGDFGLATEKSRWSGSHQF

SEQ ID NO: 22848 - protein, 15 aa, Homo sapiens
  Native (BRAF V600E)
FGLATEKSRWSGSHQ

SEQ ID NO: 22849 - protein, 23 aa, Homo sapiens
  Native (BRAF V600E)
FLHEDLTVKIGDFGLATEKSRWS

SEQ ID NO: 22850 - protein, 24 aa, Homo sapiens
  Native (BRAF V600E)
FLHEDLTVKIGDFGLATEKSRWSG

SEQ ID NO: 22851 - protein, 25 aa, Homo sapiens
  Native (BRAF V600E)
FLHEDLTVKIGDFGLATEKSRWSGS

SEQ ID NO: 22852 - protein, 20 aa, Homo sapiens
  Native (BRAF V600E)
HEDLTVKIGDFGLATEKSRW

SEQ ID NO: 22853 - protein, 21 aa, Homo sapiens
  Native (BRAF V600E)
HEDLTVKIGDFGLATEKSRWS

SEQ ID NO: 22854 - protein, 22 aa, Homo sapiens
  Native (BRAF V600E)
HEDLTVKIGDFGLATEKSRWSG

SEQ ID NO: 22855 - protein, 23 aa, Homo sapiens
  Native (BRAF V600E)
HEDLTVKIGDFGLATEKSRWSGS

SEQ ID NO: 22856 - protein, 24 aa, Homo sapiens
  Native (BRAF V600E)
HEDLTVKIGDFGLATEKSRWSGSH

SEQ ID NO: 22857 - protein, 25 aa, Homo sapiens
  Native (BRAF V600E)
HEDLTVKIGDFGLATEKSRWSGSHQ

SEQ ID NO: 22858 - protein, 23 aa, Homo sapiens
  Native (BRAF V600E)
IFLHEDLTVKIGDFGLATEKSRW

SEQ ID NO: 22859 - protein, 24 aa, Homo sapiens
  Native (BRAF V600E)
IFLHEDLTVKIGDFGLATEKSRWS

SEQ ID NO: 22860 - protein, 25 aa, Homo sapiens
  Native (BRAF V600E)
IFLHEDLTVKIGDFGLATEKSRWSG

SEQ ID NO: 22861 - protein, 15 aa, Homo sapiens
  Native (BRAF V600E)
KIGDFGLATEKSRWS

SEQ ID NO: 22862 - protein, 16 aa, Homo sapiens
  Native (BRAF V600E)
KIGDFGLATEKSRWSG

SEQ ID NO: 22863 - protein, 17 aa, Homo sapiens
  Native (BRAF V600E)
KIGDFGLATEKSRWSGS

SEQ ID NO: 22864 - protein, 22 aa, Homo sapiens
  Native (BRAF V600E)
LHEDLTVKIGDFGLATEKSRWS

SEQ ID NO: 22865 - protein, 23 aa, Homo sapiens
  Native (BRAF V600E)
LHEDLTVKIGDFGLATEKSRWSG

SEQ ID NO: 22866 - protein, 24 aa, Homo sapiens
  Native (BRAF V600E)
LHEDLTVKIGDFGLATEKSRWSGS

SEQ ID NO: 22867 - protein, 25 aa, Homo sapiens
  Native (BRAF V600E)
LHEDLTVKIGDFGLATEKSRWSGSH

SEQ ID NO: 22868 - protein, 17 aa, Homo sapiens
  Native (BRAF V600E)
LTVKIGDFGLATEKSRW

SEQ ID NO: 22869 - protein, 19 aa, Homo sapiens
  Native (BRAF V600E)
LTVKIGDFGLATEKSRWSG

SEQ ID NO: 22870 - protein, 20 aa, Homo sapiens
  Native (BRAF V600E)
LTVKIGDFGLATEKSRWSGS

SEQ ID NO: 22871 - protein, 25 aa, Homo sapiens
  Native (BRAF V600E)
NIFLHEDLTVKIGDFGLATEKSRWS

SEQ ID NO: 22872 - protein, 15 aa, Homo sapiens
  Native (BRAF V600E)
TVKIGDFGLATEKSR

SEQ ID NO: 22873 - protein, 17 aa, Homo sapiens
  Native (BRAF V600E)
TVKIGDFGLATEKSRWS

SEQ ID NO: 22874 - protein, 19 aa, Homo sapiens
  Native (BRAF V600E)
TVKIGDFGLATEKSRWSGS

SEQ ID NO: 22875 - protein, 15 aa, Homo sapiens
  Native (BRAF V600E)
VKIGDFGLATEKSRW

SEQ ID NO: 22876 - protein, 17 aa, Homo sapiens
  Native (BRAF V600E)
VKIGDFGLATEKSRWSG

SEQ ID NO: 22877 - protein, 17 aa, Homo sapiens
  Native (BRAF V600M)
DFGLATMKSRWSGSHQF

SEQ ID NO: 22878 - protein, 19 aa, Homo sapiens
  Native (BRAF V600M)
DFGLATMKSRWSGSHQFEQ

SEQ ID NO: 22879 - protein, 20 aa, Homo sapiens
  Native (BRAF V600M)
DFGLATMKSRWSGSHQFEQL

SEQ ID NO: 22880 - protein, 21 aa, Homo sapiens
  Native (BRAF V600M)
DFGLATMKSRWSGSHQFEQLS

SEQ ID NO: 22881 - protein, 22 aa, Homo sapiens
  Native (BRAF V600M)
DFGLATMKSRWSGSHQFEQLSG

SEQ ID NO: 22882 - protein, 23 aa, Homo sapiens
  Native (BRAF V600M)
DFGLATMKSRWSGSHQFEQLSGS

SEQ ID NO: 22883 - protein, 24 aa, Homo sapiens
  Native (BRAF V600M)
DFGLATMKSRWSGSHQFEQLSGSI

SEQ ID NO: 22884 - protein, 25 aa, Homo sapiens
  Native (BRAF V600M)
DFGLATMKSRWSGSHQFEQLSGSIL

SEQ ID NO: 22885 - protein, 17 aa, Homo sapiens
  Native (BRAF V600M)
DLTVKIGDFGLATMKSR

SEQ ID NO: 22886 - protein, 19 aa, Homo sapiens
  Native (BRAF V600M)
DLTVKIGDFGLATMKSRWS

SEQ ID NO: 22887 - protein, 20 aa, Homo sapiens
  Native (BRAF V600M)
DLTVKIGDFGLATMKSRWSG

SEQ ID NO: 22888 - protein, 21 aa, Homo sapiens
  Native (BRAF V600M)
DLTVKIGDFGLATMKSRWSGS

SEQ ID NO: 22889 - protein, 22 aa, Homo sapiens
  Native (BRAF V600M)
DLTVKIGDFGLATMKSRWSGSH

SEQ ID NO: 22890 - protein, 23 aa, Homo sapiens
  Native (BRAF V600M)
DLTVKIGDFGLATMKSRWSGSHQ

SEQ ID NO: 22891 - protein, 24 aa, Homo sapiens
  Native (BRAF V600M)
DLTVKIGDFGLATMKSRWSGSHQF

SEQ ID NO: 22892 - protein, 25 aa, Homo sapiens
  Native (BRAF V600M)
DLTVKIGDFGLATMKSRWSGSHQFE

SEQ ID NO: 22893 - protein, 19 aa, Homo sapiens
  Native (BRAF V600M)
EDLTVKIGDFGLATMKSRW

SEQ ID NO: 22894 - protein, 20 aa, Homo sapiens
  Native (BRAF V600M)
EDLTVKIGDFGLATMKSRWS

SEQ ID NO: 22895 - protein, 21 aa, Homo sapiens
  Native (BRAF V600M)
EDLTVKIGDFGLATMKSRWSG

SEQ ID NO: 22896 - protein, 22 aa, Homo sapiens
  Native (BRAF V600M)
EDLTVKIGDFGLATMKSRWSGS

SEQ ID NO: 22897 - protein, 23 aa, Homo sapiens
  Native (BRAF V600M)
EDLTVKIGDFGLATMKSRWSGSH

SEQ ID NO: 22898 - protein, 24 aa, Homo sapiens
  Native (BRAF V600M)
EDLTVKIGDFGLATMKSRWSGSHQ

SEQ ID NO: 22899 - protein, 25 aa, Homo sapiens
  Native (BRAF V600M)
EDLTVKIGDFGLATMKSRWSGSHQF

SEQ ID NO: 22900 - protein, 14 aa, Homo sapiens
  Native (BRAF V600M)
FGLATMKSRWSGSH

SEQ ID NO: 22901 - protein, 15 aa, Homo sapiens
  Native (BRAF V600M)
FGLATMKSRWSGSHQ

SEQ ID NO: 22902 - protein, 16 aa, Homo sapiens
  Native (BRAF V600M)
FGLATMKSRWSGSHQF

SEQ ID NO: 22903 - protein, 17 aa, Homo sapiens
  Native (BRAF V600M)
FGLATMKSRWSGSHQFE

SEQ ID NO: 22904 - protein, 19 aa, Homo sapiens
  Native (BRAF V600M)
FGLATMKSRWSGSHQFEQL

SEQ ID NO: 22905 - protein, 20 aa, Homo sapiens
  Native (BRAF V600M)
FGLATMKSRWSGSHQFEQLS

SEQ ID NO: 22906 - protein, 21 aa, Homo sapiens
  Native (BRAF V600M)
FGLATMKSRWSGSHQFEQLSG

SEQ ID NO: 22907 - protein, 22 aa, Homo sapiens
  Native (BRAF V600M)
FGLATMKSRWSGSHQFEQLSGS

SEQ ID NO: 22908 - protein, 23 aa, Homo sapiens
  Native (BRAF V600M)
FGLATMKSRWSGSHQFEQLSGSI

SEQ ID NO: 22909 - protein, 24 aa, Homo sapiens
  Native (BRAF V600M)
FGLATMKSRWSGSHQFEQLSGSIL

SEQ ID NO: 22910 - protein, 25 aa, Homo sapiens
  Native (BRAF V600M)
FGLATMKSRWSGSHQFEQLSGSILW

SEQ ID NO: 22911 - protein, 23 aa, Homo sapiens
  Native (BRAF V600M)
FLHEDLTVKIGDFGLATMKSRWS

SEQ ID NO: 22912 - protein, 24 aa, Homo sapiens
  Native (BRAF V600M)
FLHEDLTVKIGDFGLATMKSRWSG

SEQ ID NO: 22913 - protein, 25 aa, Homo sapiens
  Native (BRAF V600M)
FLHEDLTVKIGDFGLATMKSRWSGS

SEQ ID NO: 22914 - protein, 19 aa, Homo sapiens
  Native (BRAF V600M)
GDFGLATMKSRWSGSHQFE

SEQ ID NO: 22915 - protein, 20 aa, Homo sapiens
  Native (BRAF V600M)
GDFGLATMKSRWSGSHQFEQ

SEQ ID NO: 22916 - protein, 21 aa, Homo sapiens
  Native (BRAF V600M)
GDFGLATMKSRWSGSHQFEQL

SEQ ID NO: 22917 - protein, 22 aa, Homo sapiens
  Native (BRAF V600M)
GDFGLATMKSRWSGSHQFEQLS

SEQ ID NO: 22918 - protein, 23 aa, Homo sapiens
  Native (BRAF V600M)
GDFGLATMKSRWSGSHQFEQLSG

SEQ ID NO: 22919 - protein, 24 aa, Homo sapiens
  Native (BRAF V600M)
GDFGLATMKSRWSGSHQFEQLSGS

SEQ ID NO: 22920 - protein, 25 aa, Homo sapiens
  Native (BRAF V600M)
GDFGLATMKSRWSGSHQFEQLSGSI

SEQ ID NO: 22921 - protein, 14 aa, Homo sapiens
  Native (BRAF V600M)
GLATMKSRWSGSHQ

SEQ ID NO: 22922 - protein, 15 aa, Homo sapiens
  Native (BRAF V600M)
GLATMKSRWSGSHQF

SEQ ID NO: 22923 - protein, 16 aa, Homo sapiens
  Native (BRAF V600M)
GLATMKSRWSGSHQFE

SEQ ID NO: 22924 - protein, 17 aa, Homo sapiens
  Native (BRAF V600M)
GLATMKSRWSGSHQFEQ

SEQ ID NO: 22925 - protein, 20 aa, Homo sapiens
  Native (BRAF V600M)
GLATMKSRWSGSHQFEQLSG

SEQ ID NO: 22926 - protein, 20 aa, Homo sapiens
  Native (BRAF V600M)
HEDLTVKIGDFGLATMKSRW

SEQ ID NO: 22927 - protein, 21 aa, Homo sapiens
  Native (BRAF V600M)
HEDLTVKIGDFGLATMKSRWS

SEQ ID NO: 22928 - protein, 22 aa, Homo sapiens
  Native (BRAF V600M)
HEDLTVKIGDFGLATMKSRWSG

SEQ ID NO: 22929 - protein, 23 aa, Homo sapiens
  Native (BRAF V600M)
HEDLTVKIGDFGLATMKSRWSGS

SEQ ID NO: 22930 - protein, 24 aa, Homo sapiens
  Native (BRAF V600M)
HEDLTVKIGDFGLATMKSRWSGSH

SEQ ID NO: 22931 - protein, 25 aa, Homo sapiens
  Native (BRAF V600M)
HEDLTVKIGDFGLATMKSRWSGSHQ

SEQ ID NO: 22932 - protein, 24 aa, Homo sapiens
  Native (BRAF V600M)
IFLHEDLTVKIGDFGLATMKSRWS

SEQ ID NO: 22933 - protein, 25 aa, Homo sapiens
  Native (BRAF V600M)
IFLHEDLTVKIGDFGLATMKSRWSG

SEQ ID NO: 22934 - protein, 14 aa, Homo sapiens
  Native (BRAF V600M)
IGDFGLATMKSRWS

SEQ ID NO: 22935 - protein, 19 aa, Homo sapiens
  Native (BRAF V600M)
IGDFGLATMKSRWSGSHQF

SEQ ID NO: 22936 - protein, 20 aa, Homo sapiens
  Native (BRAF V600M)
IGDFGLATMKSRWSGSHQFE

SEQ ID NO: 22937 - protein, 21 aa, Homo sapiens
  Native (BRAF V600M)
IGDFGLATMKSRWSGSHQFEQ

SEQ ID NO: 22938 - protein, 22 aa, Homo sapiens
  Native (BRAF V600M)
IGDFGLATMKSRWSGSHQFEQL

SEQ ID NO: 22939 - protein, 23 aa, Homo sapiens
  Native (BRAF V600M)
IGDFGLATMKSRWSGSHQFEQLS

SEQ ID NO: 22940 - protein, 14 aa, Homo sapiens
  Native (BRAF V600M)
KIGDFGLATMKSRW

SEQ ID NO: 22941 - protein, 15 aa, Homo sapiens
  Native (BRAF V600M)
KIGDFGLATMKSRWS

SEQ ID NO: 22942 - protein, 16 aa, Homo sapiens
  Native (BRAF V600M)
KIGDFGLATMKSRWSG

SEQ ID NO: 22943 - protein, 17 aa, Homo sapiens
  Native (BRAF V600M)
KIGDFGLATMKSRWSGS

SEQ ID NO: 22944 - protein, 19 aa, Homo sapiens
  Native (BRAF V600M)
KIGDFGLATMKSRWSGSHQ

SEQ ID NO: 22945 - protein, 20 aa, Homo sapiens
  Native (BRAF V600M)
KIGDFGLATMKSRWSGSHQF

SEQ ID NO: 22946 - protein, 20 aa, Homo sapiens
  Native (BRAF V600M)
LHEDLTVKIGDFGLATMKSR

SEQ ID NO: 22947 - protein, 22 aa, Homo sapiens
  Native (BRAF V600M)
LHEDLTVKIGDFGLATMKSRWS

SEQ ID NO: 22948 - protein, 23 aa, Homo sapiens
  Native (BRAF V600M)
LHEDLTVKIGDFGLATMKSRWSG

SEQ ID NO: 22949 - protein, 24 aa, Homo sapiens
  Native (BRAF V600M)
LHEDLTVKIGDFGLATMKSRWSGS

SEQ ID NO: 22950 - protein, 25 aa, Homo sapiens
  Native (BRAF V600M)
LHEDLTVKIGDFGLATMKSRWSGSH

SEQ ID NO: 22951 - protein, 16 aa, Homo sapiens
  Native (BRAF V600M)
LTVKIGDFGLATMKSR

SEQ ID NO: 22952 - protein, 17 aa, Homo sapiens
  Native (BRAF V600M)
LTVKIGDFGLATMKSRW

SEQ ID NO: 22953 - protein, 18 aa, Homo sapiens
  Native (BRAF V600M)
LTVKIGDFGLATMKSRWS

SEQ ID NO: 22954 - protein, 19 aa, Homo sapiens
  Native (BRAF V600M)
LTVKIGDFGLATMKSRWSG

SEQ ID NO: 22955 - protein, 20 aa, Homo sapiens
  Native (BRAF V600M)
LTVKIGDFGLATMKSRWSGS

SEQ ID NO: 22956 - protein, 21 aa, Homo sapiens
  Native (BRAF V600M)
LTVKIGDFGLATMKSRWSGSH

SEQ ID NO: 22957 - protein, 25 aa, Homo sapiens
  Native (BRAF V600M)
NIFLHEDLTVKIGDFGLATMKSRWS

SEQ ID NO: 22958 - protein, 15 aa, Homo sapiens
  Native (BRAF V600M)
TVKIGDFGLATMKSR

SEQ ID NO: 22959 - protein, 16 aa, Homo sapiens
  Native (BRAF V600M)
TVKIGDFGLATMKSRW

SEQ ID NO: 22960 - protein, 17 aa, Homo sapiens
  Native (BRAF V600M)
TVKIGDFGLATMKSRWS

SEQ ID NO: 22961 - protein, 19 aa, Homo sapiens
  Native (BRAF V600M)
TVKIGDFGLATMKSRWSGS

SEQ ID NO: 22962 - protein, 14 aa, Homo sapiens
  Native (BRAF V600M)
VKIGDFGLATMKSR

SEQ ID NO: 22963 - protein, 15 aa, Homo sapiens
  Native (BRAF V600M)
VKIGDFGLATMKSRW

SEQ ID NO: 22964 - protein, 16 aa, Homo sapiens
  Native (BRAF V600M)
VKIGDFGLATMKSRWS

SEQ ID NO: 22965 - protein, 17 aa, Homo sapiens
  Native (BRAF V600M)
VKIGDFGLATMKSRWSG

SEQ ID NO: 22966 - protein, 20 aa, Homo sapiens
  Native (BRAF V600M)
VKIGDFGLATMKSRWSGSHQ

SEQ ID NO: 22967 - protein, 20 aa, Homo sapiens
  Native (EGFR A289V)
DVNPEGKYSFGVTCVKKCPR

SEQ ID NO: 22968 - protein, 23 aa, Homo sapiens
  Native (EGFR A289V)
DVNPEGKYSFGVTCVKKCPRNYV

SEQ ID NO: 22969 - protein, 24 aa, Homo sapiens
  Native (EGFR A289V)
DVNPEGKYSFGVTCVKKCPRNYVV

SEQ ID NO: 22970 - protein, 25 aa, Homo sapiens
  Native (EGFR A289V)
DVNPEGKYSFGVTCVKKCPRNYVVT

SEQ ID NO: 22971 - protein, 15 aa, Homo sapiens
  Native (EGFR A289V)
EGKYSFGVTCVKKCP

SEQ ID NO: 22972 - protein, 17 aa, Homo sapiens
  Native (EGFR A289V)
EGKYSFGVTCVKKCPRN

SEQ ID NO: 22973 - protein, 20 aa, Homo sapiens
  Native (EGFR A289V)
EGKYSFGVTCVKKCPRNYVV

SEQ ID NO: 22974 - protein, 15 aa, Homo sapiens
  Native (EGFR A289V)
GKYSFGVTCVKKCPR

SEQ ID NO: 22975 - protein, 20 aa, Homo sapiens
  Native (EGFR A289V)
GKYSFGVTCVKKCPRNYVVT

SEQ ID NO: 22976 - protein, 15 aa, Homo sapiens
  Native (EGFR A289V)
KYSFGVTCVKKCPRN

SEQ ID NO: 22977 - protein, 20 aa, Homo sapiens
  Native (EGFR A289V)
MDVNPEGKYSFGVTCVKKCP

SEQ ID NO: 22978 - protein, 23 aa, Homo sapiens
  Native (EGFR A289V)
MDVNPEGKYSFGVTCVKKCPRNY

SEQ ID NO: 22979 - protein, 24 aa, Homo sapiens
  Native (EGFR A289V)
MDVNPEGKYSFGVTCVKKCPRNYV

SEQ ID NO: 22980 - protein, 25 aa, Homo sapiens
  Native (EGFR A289V)
MDVNPEGKYSFGVTCVKKCPRNYVV

SEQ ID NO: 22981 - protein, 15 aa, Homo sapiens
  Native (EGFR A289V)
NPEGKYSFGVTCVKK

SEQ ID NO: 22982 - protein, 20 aa, Homo sapiens
  Native (EGFR A289V)
NPEGKYSFGVTCVKKCPRNY

SEQ ID NO: 22983 - protein, 23 aa, Homo sapiens
  Native (EGFR A289V)
NPEGKYSFGVTCVKKCPRNYVVT

SEQ ID NO: 22984 - protein, 24 aa, Homo sapiens
  Native (EGFR A289V)
NPEGKYSFGVTCVKKCPRNYVVTD

SEQ ID NO: 22985 - protein, 25 aa, Homo sapiens
  Native (EGFR A289V)
NPEGKYSFGVTCVKKCPRNYVVTDH

SEQ ID NO: 22986 - protein, 15 aa, Homo sapiens
  Native (EGFR A289V)
PEGKYSFGVTCVKKC

SEQ ID NO: 22987 - protein, 17 aa, Homo sapiens
  Native (EGFR A289V)
PEGKYSFGVTCVKKCPR

SEQ ID NO: 22988 - protein, 20 aa, Homo sapiens
  Native (EGFR A289V)
PEGKYSFGVTCVKKCPRNYV

SEQ ID NO: 22989 - protein, 20 aa, Homo sapiens
  Native (EGFR A289V)
QMDVNPEGKYSFGVTCVKKC

SEQ ID NO: 22990 - protein, 24 aa, Homo sapiens
  Native (EGFR A289V)
QMDVNPEGKYSFGVTCVKKCPRNY

SEQ ID NO: 22991 - protein, 25 aa, Homo sapiens
  Native (EGFR A289V)
QMDVNPEGKYSFGVTCVKKCPRNYV

SEQ ID NO: 22992 - protein, 24 aa, Homo sapiens
  Native (EGFR A289V)
TYQMDVNPEGKYSFGVTCVKKCPR

SEQ ID NO: 22993 - protein, 25 aa, Homo sapiens
  Native (EGFR A289V)
TYQMDVNPEGKYSFGVTCVKKCPRN

SEQ ID NO: 22994 - protein, 20 aa, Homo sapiens
  Native (EGFR A289V)
VNPEGKYSFGVTCVKKCPRN

SEQ ID NO: 22995 - protein, 23 aa, Homo sapiens
  Native (EGFR A289V)
VNPEGKYSFGVTCVKKCPRNYVV

SEQ ID NO: 22996 - protein, 24 aa, Homo sapiens
  Native (EGFR A289V)
VNPEGKYSFGVTCVKKCPRNYVVT

SEQ ID NO: 22997 - protein, 25 aa, Homo sapiens
  Native (EGFR A289V)
VNPEGKYSFGVTCVKKCPRNYVVTD

SEQ ID NO: 22998 - protein, 20 aa, Homo sapiens
  Native (EGFR A289V)
YQMDVNPEGKYSFGVTCVKK

SEQ ID NO: 22999 - protein, 24 aa, Homo sapiens
  Native (EGFR A289V)
YQMDVNPEGKYSFGVTCVKKCPRN

SEQ ID NO: 23000 - protein, 25 aa, Homo sapiens
  Native (EGFR A289V)
YQMDVNPEGKYSFGVTCVKKCPRNY

SEQ ID NO: 23001 - protein, 20 aa, Homo sapiens
  Native (EGFR G598V)
AHYIDGPHCVKTCPAVVMGE

SEQ ID NO: 23002 - protein, 21 aa, Homo sapiens
  Native (EGFR G598V)
AHYIDGPHCVKTCPAVVMGEN

SEQ ID NO: 23003 - protein, 22 aa, Homo sapiens
  Native (EGFR G598V)
AHYIDGPHCVKTCPAVVMGENN

SEQ ID NO: 23004 - protein, 23 aa, Homo sapiens
  Native (EGFR G598V)
AHYIDGPHCVKTCPAVVMGENNT

SEQ ID NO: 23005 - protein, 24 aa, Homo sapiens
  Native (EGFR G598V)
AHYIDGPHCVKTCPAVVMGENNTL

SEQ ID NO: 23006 - protein, 25 aa, Homo sapiens
  Native (EGFR G598V)
AHYIDGPHCVKTCPAVVMGENNTLV

SEQ ID NO: 23007 - protein, 20 aa, Homo sapiens
  Native (EGFR G598V)
CAHYIDGPHCVKTCPAVVMG

SEQ ID NO: 23008 - protein, 21 aa, Homo sapiens
  Native (EGFR G598V)
CAHYIDGPHCVKTCPAVVMGE

SEQ ID NO: 23009 - protein, 22 aa, Homo sapiens
  Native (EGFR G598V)
CAHYIDGPHCVKTCPAVVMGEN

SEQ ID NO: 23010 - protein, 23 aa, Homo sapiens
  Native (EGFR G598V)
CAHYIDGPHCVKTCPAVVMGENN

SEQ ID NO: 23011 - protein, 24 aa, Homo sapiens
  Native (EGFR G598V)
CAHYIDGPHCVKTCPAVVMGENNT

SEQ ID NO: 23012 - protein, 25 aa, Homo sapiens
  Native (EGFR G598V)
CAHYIDGPHCVKTCPAVVMGENNTL

SEQ ID NO: 23013 - protein, 23 aa, Homo sapiens
  Native (EGFR G598V)
CIQCAHYIDGPHCVKTCPAVVMG

SEQ ID NO: 23014 - protein, 24 aa, Homo sapiens
  Native (EGFR G598V)
CIQCAHYIDGPHCVKTCPAVVMGE

SEQ ID NO: 23015 - protein, 25 aa, Homo sapiens
  Native (EGFR G598V)
CIQCAHYIDGPHCVKTCPAVVMGEN

SEQ ID NO: 23016 - protein, 15 aa, Homo sapiens
  Native (EGFR G598V)
CVKTCPAVVMGENNT

SEQ ID NO: 23017 - protein, 16 aa, Homo sapiens
  Native (EGFR G598V)
CVKTCPAVVMGENNTL

SEQ ID NO: 23018 - protein, 15 aa, Homo sapiens
  Native (EGFR G598V)
DGPHCVKTCPAVVMG

SEQ ID NO: 23019 - protein, 16 aa, Homo sapiens
  Native (EGFR G598V)
DGPHCVKTCPAVVMGE

SEQ ID NO: 23020 - protein, 17 aa, Homo sapiens
  Native (EGFR G598V)
DGPHCVKTCPAVVMGEN

SEQ ID NO: 23021 - protein, 19 aa, Homo sapiens
  Native (EGFR G598V)
DGPHCVKTCPAVVMGENNT

SEQ ID NO: 23022 - protein, 20 aa, Homo sapiens
  Native (EGFR G598V)
DGPHCVKTCPAVVMGENNTL

SEQ ID NO: 23023 - protein, 21 aa, Homo sapiens
  Native (EGFR G598V)
DGPHCVKTCPAVVMGENNTLV

SEQ ID NO: 23024 - protein, 22 aa, Homo sapiens
  Native (EGFR G598V)
DGPHCVKTCPAVVMGENNTLVW

SEQ ID NO: 23025 - protein, 23 aa, Homo sapiens
  Native (EGFR G598V)
DGPHCVKTCPAVVMGENNTLVWK

SEQ ID NO: 23026 - protein, 24 aa, Homo sapiens
  Native (EGFR G598V)
DGPHCVKTCPAVVMGENNTLVWKY

SEQ ID NO: 23027 - protein, 25 aa, Homo sapiens
  Native (EGFR G598V)
DGPHCVKTCPAVVMGENNTLVWKYA

SEQ ID NO: 23028 - protein, 24 aa, Homo sapiens
  Native (EGFR G598V)
DNCIQCAHYIDGPHCVKTCPAVVM

SEQ ID NO: 23029 - protein, 25 aa, Homo sapiens
  Native (EGFR G598V)
DNCIQCAHYIDGPHCVKTCPAVVMG

SEQ ID NO: 23030 - protein, 15 aa, Homo sapiens
  Native (EGFR G598V)
GPHCVKTCPAVVMGE

SEQ ID NO: 23031 - protein, 16 aa, Homo sapiens
  Native (EGFR G598V)
GPHCVKTCPAVVMGEN

SEQ ID NO: 23032 - protein, 17 aa, Homo sapiens
  Native (EGFR G598V)
GPHCVKTCPAVVMGENN

SEQ ID NO: 23033 - protein, 19 aa, Homo sapiens
  Native (EGFR G598V)
GPHCVKTCPAVVMGENNTL

SEQ ID NO: 23034 - protein, 20 aa, Homo sapiens
  Native (EGFR G598V)
GPHCVKTCPAVVMGENNTLV

SEQ ID NO: 23035 - protein, 21 aa, Homo sapiens
  Native (EGFR G598V)
GPHCVKTCPAVVMGENNTLVW

SEQ ID NO: 23036 - protein, 22 aa, Homo sapiens
  Native (EGFR G598V)
GPHCVKTCPAVVMGENNTLVWK

SEQ ID NO: 23037 - protein, 23 aa, Homo sapiens
  Native (EGFR G598V)
GPHCVKTCPAVVMGENNTLVWKY

SEQ ID NO: 23038 - protein, 24 aa, Homo sapiens
  Native (EGFR G598V)
GPHCVKTCPAVVMGENNTLVWKYA

SEQ ID NO: 23039 - protein, 25 aa, Homo sapiens
  Native (EGFR G598V)
GPHCVKTCPAVVMGENNTLVWKYAD

SEQ ID NO: 23040 - protein, 14 aa, Homo sapiens
  Native (EGFR G598V)
HCVKTCPAVVMGEN

SEQ ID NO: 23041 - protein, 15 aa, Homo sapiens
  Native (EGFR G598V)
HCVKTCPAVVMGENN

SEQ ID NO: 23042 - protein, 16 aa, Homo sapiens
  Native (EGFR G598V)
HCVKTCPAVVMGENNT

SEQ ID NO: 23043 - protein, 17 aa, Homo sapiens
  Native (EGFR G598V)
HCVKTCPAVVMGENNTL

SEQ ID NO: 23044 - protein, 19 aa, Homo sapiens
  Native (EGFR G598V)
HCVKTCPAVVMGENNTLVW

SEQ ID NO: 23045 - protein, 17 aa, Homo sapiens
  Native (EGFR G598V)
HYIDGPHCVKTCPAVVM

SEQ ID NO: 23046 - protein, 20 aa, Homo sapiens
  Native (EGFR G598V)
HYIDGPHCVKTCPAVVMGEN

SEQ ID NO: 23047 - protein, 21 aa, Homo sapiens
  Native (EGFR G598V)
HYIDGPHCVKTCPAVVMGENN

SEQ ID NO: 23048 - protein, 22 aa, Homo sapiens
  Native (EGFR G598V)
HYIDGPHCVKTCPAVVMGENNT

SEQ ID NO: 23049 - protein, 23 aa, Homo sapiens
  Native (EGFR G598V)
HYIDGPHCVKTCPAVVMGENNTL

SEQ ID NO: 23050 - protein, 24 aa, Homo sapiens
  Native (EGFR G598V)
HYIDGPHCVKTCPAVVMGENNTLV

SEQ ID NO: 23051 - protein, 25 aa, Homo sapiens
  Native (EGFR G598V)
HYIDGPHCVKTCPAVVMGENNTLVW

SEQ ID NO: 23052 - protein, 15 aa, Homo sapiens
  Native (EGFR G598V)
IDGPHCVKTCPAVVM

SEQ ID NO: 23053 - protein, 16 aa, Homo sapiens
  Native (EGFR G598V)
IDGPHCVKTCPAVVMG

SEQ ID NO: 23054 - protein, 17 aa, Homo sapiens
  Native (EGFR G598V)
IDGPHCVKTCPAVVMGE

SEQ ID NO: 23055 - protein, 20 aa, Homo sapiens
  Native (EGFR G598V)
IDGPHCVKTCPAVVMGENNT

SEQ ID NO: 23056 - protein, 21 aa, Homo sapiens
  Native (EGFR G598V)
IDGPHCVKTCPAVVMGENNTL

SEQ ID NO: 23057 - protein, 22 aa, Homo sapiens
  Native (EGFR G598V)
IDGPHCVKTCPAVVMGENNTLV

SEQ ID NO: 23058 - protein, 23 aa, Homo sapiens
  Native (EGFR G598V)
IDGPHCVKTCPAVVMGENNTLVW

SEQ ID NO: 23059 - protein, 24 aa, Homo sapiens
  Native (EGFR G598V)
IDGPHCVKTCPAVVMGENNTLVWK

SEQ ID NO: 23060 - protein, 25 aa, Homo sapiens
  Native (EGFR G598V)
IDGPHCVKTCPAVVMGENNTLVWKY

SEQ ID NO: 23061 - protein, 22 aa, Homo sapiens
  Native (EGFR G598V)
IQCAHYIDGPHCVKTCPAVVMG

SEQ ID NO: 23062 - protein, 23 aa, Homo sapiens
  Native (EGFR G598V)
IQCAHYIDGPHCVKTCPAVVMGE

SEQ ID NO: 23063 - protein, 24 aa, Homo sapiens
  Native (EGFR G598V)
IQCAHYIDGPHCVKTCPAVVMGEN

SEQ ID NO: 23064 - protein, 25 aa, Homo sapiens
  Native (EGFR G598V)
IQCAHYIDGPHCVKTCPAVVMGENN

SEQ ID NO: 23065 - protein, 24 aa, Homo sapiens
  Native (EGFR G598V)
NCIQCAHYIDGPHCVKTCPAVVMG

SEQ ID NO: 23066 - protein, 25 aa, Homo sapiens
  Native (EGFR G598V)
NCIQCAHYIDGPHCVKTCPAVVMGE

SEQ ID NO: 23067 - protein, 25 aa, Homo sapiens
  Native (EGFR G598V)
PDNCIQCAHYIDGPHCVKTCPAVVM

SEQ ID NO: 23068 - protein, 14 aa, Homo sapiens
  Native (EGFR G598V)
PHCVKTCPAVVMGE

SEQ ID NO: 23069 - protein, 15 aa, Homo sapiens
  Native (EGFR G598V)
PHCVKTCPAVVMGEN

SEQ ID NO: 23070 - protein, 16 aa, Homo sapiens
  Native (EGFR G598V)
PHCVKTCPAVVMGENN

SEQ ID NO: 23071 - protein, 17 aa, Homo sapiens
  Native (EGFR G598V)
PHCVKTCPAVVMGENNT

SEQ ID NO: 23072 - protein, 19 aa, Homo sapiens
  Native (EGFR G598V)
PHCVKTCPAVVMGENNTLV

SEQ ID NO: 23073 - protein, 20 aa, Homo sapiens
  Native (EGFR G598V)
PHCVKTCPAVVMGENNTLVW

SEQ ID NO: 23074 - protein, 20 aa, Homo sapiens
  Native (EGFR G598V)
QCAHYIDGPHCVKTCPAVVM

SEQ ID NO: 23075 - protein, 21 aa, Homo sapiens
  Native (EGFR G598V)
QCAHYIDGPHCVKTCPAVVMG

SEQ ID NO: 23076 - protein, 22 aa, Homo sapiens
  Native (EGFR G598V)
QCAHYIDGPHCVKTCPAVVMGE

SEQ ID NO: 23077 - protein, 23 aa, Homo sapiens
  Native (EGFR G598V)
QCAHYIDGPHCVKTCPAVVMGEN

SEQ ID NO: 23078 - protein, 24 aa, Homo sapiens
  Native (EGFR G598V)
QCAHYIDGPHCVKTCPAVVMGENN

SEQ ID NO: 23079 - protein, 25 aa, Homo sapiens
  Native (EGFR G598V)
QCAHYIDGPHCVKTCPAVVMGENNT

SEQ ID NO: 23080 - protein, 15 aa, Homo sapiens
  Native (EGFR G598V)
VKTCPAVVMGENNTL

SEQ ID NO: 23081 - protein, 15 aa, Homo sapiens
  Native (EGFR G598V)
YIDGPHCVKTCPAVV

SEQ ID NO: 23082 - protein, 16 aa, Homo sapiens
  Native (EGFR G598V)
YIDGPHCVKTCPAVVM

SEQ ID NO: 23083 - protein, 17 aa, Homo sapiens
  Native (EGFR G598V)
YIDGPHCVKTCPAVVMG

SEQ ID NO: 23084 - protein, 20 aa, Homo sapiens
  Native (EGFR G598V)
YIDGPHCVKTCPAVVMGENN

SEQ ID NO: 23085 - protein, 21 aa, Homo sapiens
  Native (EGFR G598V)
YIDGPHCVKTCPAVVMGENNT

SEQ ID NO: 23086 - protein, 22 aa, Homo sapiens
  Native (EGFR G598V)
YIDGPHCVKTCPAVVMGENNTL

SEQ ID NO: 23087 - protein, 23 aa, Homo sapiens
  Native (EGFR G598V)
YIDGPHCVKTCPAVVMGENNTLV

SEQ ID NO: 23088 - protein, 24 aa, Homo sapiens
  Native (EGFR G598V)
YIDGPHCVKTCPAVVMGENNTLVW

SEQ ID NO: 23089 - protein, 25 aa, Homo sapiens
  Native (EGFR G598V)
YIDGPHCVKTCPAVVMGENNTLVWK

SEQ ID NO: 23090 - protein, 22 aa, Homo sapiens
  Native (EGFR L858R)
AARNVLVKTPQHVKITDFGRAK

SEQ ID NO: 23091 - protein, 23 aa, Homo sapiens
  Native (EGFR L858R)
AARNVLVKTPQHVKITDFGRAKL

SEQ ID NO: 23092 - protein, 24 aa, Homo sapiens
  Native (EGFR L858R)
AARNVLVKTPQHVKITDFGRAKLL

SEQ ID NO: 23093 - protein, 25 aa, Homo sapiens
  Native (EGFR L858R)
AARNVLVKTPQHVKITDFGRAKLLG

SEQ ID NO: 23094 - protein, 20 aa, Homo sapiens
  Native (EGFR L858R)
ARNVLVKTPQHVKITDFGRA

SEQ ID NO: 23095 - protein, 21 aa, Homo sapiens
  Native (EGFR L858R)
ARNVLVKTPQHVKITDFGRAK

SEQ ID NO: 23096 - protein, 22 aa, Homo sapiens
  Native (EGFR L858R)
ARNVLVKTPQHVKITDFGRAKL

SEQ ID NO: 23097 - protein, 23 aa, Homo sapiens
  Native (EGFR L858R)
ARNVLVKTPQHVKITDFGRAKLL

SEQ ID NO: 23098 - protein, 24 aa, Homo sapiens
  Native (EGFR L858R)
ARNVLVKTPQHVKITDFGRAKLLG

SEQ ID NO: 23099 - protein, 25 aa, Homo sapiens
  Native (EGFR L858R)
ARNVLVKTPQHVKITDFGRAKLLGA

SEQ ID NO: 23100 - protein, 14 aa, Homo sapiens
  Native (EGFR L858R)
DFGRAKLLGAEEKE

SEQ ID NO: 23101 - protein, 15 aa, Homo sapiens
  Native (EGFR L858R)
DFGRAKLLGAEEKEY

SEQ ID NO: 23102 - protein, 16 aa, Homo sapiens
  Native (EGFR L858R)
DFGRAKLLGAEEKEYH

SEQ ID NO: 23103 - protein, 17 aa, Homo sapiens
  Native (EGFR L858R)
DFGRAKLLGAEEKEYHA

SEQ ID NO: 23104 - protein, 20 aa, Homo sapiens
  Native (EGFR L858R)
DFGRAKLLGAEEKEYHAEGG

SEQ ID NO: 23105 - protein, 24 aa, Homo sapiens
  Native (EGFR L858R)
DLAARNVLVKTPQHVKITDFGRAK

SEQ ID NO: 23106 - protein, 25 aa, Homo sapiens
  Native (EGFR L858R)
DLAARNVLVKTPQHVKITDFGRAKL

SEQ ID NO: 23107 - protein, 13 aa, Homo sapiens
  Native (EGFR L858R)
HVKITDFGRAKLL

SEQ ID NO: 23108 - protein, 14 aa, Homo sapiens
  Native (EGFR L858R)
HVKITDFGRAKLLG

SEQ ID NO: 23109 - protein, 15 aa, Homo sapiens
  Native (EGFR L858R)
HVKITDFGRAKLLGA

SEQ ID NO: 23110 - protein, 16 aa, Homo sapiens
  Native (EGFR L858R)
HVKITDFGRAKLLGAE

SEQ ID NO: 23111 - protein, 17 aa, Homo sapiens
  Native (EGFR L858R)
HVKITDFGRAKLLGAEE

SEQ ID NO: 23112 - protein, 18 aa, Homo sapiens
  Native (EGFR L858R)
HVKITDFGRAKLLGAEEK

SEQ ID NO: 23113 - protein, 19 aa, Homo sapiens
  Native (EGFR L858R)
HVKITDFGRAKLLGAEEKE

SEQ ID NO: 23114 - protein, 20 aa, Homo sapiens
  Native (EGFR L858R)
HVKITDFGRAKLLGAEEKEY

SEQ ID NO: 23115 - protein, 21 aa, Homo sapiens
  Native (EGFR L858R)
HVKITDFGRAKLLGAEEKEYH

SEQ ID NO: 23116 - protein, 22 aa, Homo sapiens
  Native (EGFR L858R)
HVKITDFGRAKLLGAEEKEYHA

SEQ ID NO: 23117 - protein, 23 aa, Homo sapiens
  Native (EGFR L858R)
HVKITDFGRAKLLGAEEKEYHAE

SEQ ID NO: 23118 - protein, 24 aa, Homo sapiens
  Native (EGFR L858R)
HVKITDFGRAKLLGAEEKEYHAEG

SEQ ID NO: 23119 - protein, 25 aa, Homo sapiens
  Native (EGFR L858R)
HVKITDFGRAKLLGAEEKEYHAEGG

SEQ ID NO: 23120 - protein, 13 aa, Homo sapiens
  Native (EGFR L858R)
ITDFGRAKLLGAE

SEQ ID NO: 23121 - protein, 14 aa, Homo sapiens
  Native (EGFR L858R)
ITDFGRAKLLGAEE

SEQ ID NO: 23122 - protein, 15 aa, Homo sapiens
  Native (EGFR L858R)
ITDFGRAKLLGAEEK

SEQ ID NO: 23123 - protein, 16 aa, Homo sapiens
  Native (EGFR L858R)
ITDFGRAKLLGAEEKE

SEQ ID NO: 23124 - protein, 17 aa, Homo sapiens
  Native (EGFR L858R)
ITDFGRAKLLGAEEKEY

SEQ ID NO: 23125 - protein, 18 aa, Homo sapiens
  Native (EGFR L858R)
ITDFGRAKLLGAEEKEYH

SEQ ID NO: 23126 - protein, 19 aa, Homo sapiens
  Native (EGFR L858R)
ITDFGRAKLLGAEEKEYHA

SEQ ID NO: 23127 - protein, 20 aa, Homo sapiens
  Native (EGFR L858R)
ITDFGRAKLLGAEEKEYHAE

SEQ ID NO: 23128 - protein, 21 aa, Homo sapiens
  Native (EGFR L858R)
ITDFGRAKLLGAEEKEYHAEG

SEQ ID NO: 23129 - protein, 22 aa, Homo sapiens
  Native (EGFR L858R)
ITDFGRAKLLGAEEKEYHAEGG

SEQ ID NO: 23130 - protein, 23 aa, Homo sapiens
  Native (EGFR L858R)
ITDFGRAKLLGAEEKEYHAEGGK

SEQ ID NO: 23131 - protein, 24 aa, Homo sapiens
  Native (EGFR L858R)
ITDFGRAKLLGAEEKEYHAEGGKV

SEQ ID NO: 23132 - protein, 25 aa, Homo sapiens
  Native (EGFR L858R)
ITDFGRAKLLGAEEKEYHAEGGKVP

SEQ ID NO: 23133 - protein, 14 aa, Homo sapiens
  Native (EGFR L858R)
KITDFGRAKLLGAE

SEQ ID NO: 23134 - protein, 15 aa, Homo sapiens
  Native (EGFR L858R)
KITDFGRAKLLGAEE

SEQ ID NO: 23135 - protein, 16 aa, Homo sapiens
  Native (EGFR L858R)
KITDFGRAKLLGAEEK

SEQ ID NO: 23136 - protein, 17 aa, Homo sapiens
  Native (EGFR L858R)
KITDFGRAKLLGAEEKE

SEQ ID NO: 23137 - protein, 18 aa, Homo sapiens
  Native (EGFR L858R)
KITDFGRAKLLGAEEKEY

SEQ ID NO: 23138 - protein, 19 aa, Homo sapiens
  Native (EGFR L858R)
KITDFGRAKLLGAEEKEYH

SEQ ID NO: 23139 - protein, 20 aa, Homo sapiens
  Native (EGFR L858R)
KITDFGRAKLLGAEEKEYHA

SEQ ID NO: 23140 - protein, 21 aa, Homo sapiens
  Native (EGFR L858R)
KITDFGRAKLLGAEEKEYHAE

SEQ ID NO: 23141 - protein, 22 aa, Homo sapiens
  Native (EGFR L858R)
KITDFGRAKLLGAEEKEYHAEG

SEQ ID NO: 23142 - protein, 23 aa, Homo sapiens
  Native (EGFR L858R)
KITDFGRAKLLGAEEKEYHAEGG

SEQ ID NO: 23143 - protein, 24 aa, Homo sapiens
  Native (EGFR L858R)
KITDFGRAKLLGAEEKEYHAEGGK

SEQ ID NO: 23144 - protein, 25 aa, Homo sapiens
  Native (EGFR L858R)
KITDFGRAKLLGAEEKEYHAEGGKV

SEQ ID NO: 23145 - protein, 15 aa, Homo sapiens
  Native (EGFR L858R)
KTPQHVKITDFGRAK

SEQ ID NO: 23146 - protein, 16 aa, Homo sapiens
  Native (EGFR L858R)
KTPQHVKITDFGRAKL

SEQ ID NO: 23147 - protein, 17 aa, Homo sapiens
  Native (EGFR L858R)
KTPQHVKITDFGRAKLL

SEQ ID NO: 23148 - protein, 18 aa, Homo sapiens
  Native (EGFR L858R)
KTPQHVKITDFGRAKLLG

SEQ ID NO: 23149 - protein, 19 aa, Homo sapiens
  Native (EGFR L858R)
KTPQHVKITDFGRAKLLGA

SEQ ID NO: 23150 - protein, 20 aa, Homo sapiens
  Native (EGFR L858R)
KTPQHVKITDFGRAKLLGAE

SEQ ID NO: 23151 - protein, 21 aa, Homo sapiens
  Native (EGFR L858R)
KTPQHVKITDFGRAKLLGAEE

SEQ ID NO: 23152 - protein, 22 aa, Homo sapiens
  Native (EGFR L858R)
KTPQHVKITDFGRAKLLGAEEK

SEQ ID NO: 23153 - protein, 23 aa, Homo sapiens
  Native (EGFR L858R)
KTPQHVKITDFGRAKLLGAEEKE

SEQ ID NO: 23154 - protein, 24 aa, Homo sapiens
  Native (EGFR L858R)
KTPQHVKITDFGRAKLLGAEEKEY

SEQ ID NO: 23155 - protein, 25 aa, Homo sapiens
  Native (EGFR L858R)
KTPQHVKITDFGRAKLLGAEEKEYH

SEQ ID NO: 23156 - protein, 23 aa, Homo sapiens
  Native (EGFR L858R)
LAARNVLVKTPQHVKITDFGRAK

SEQ ID NO: 23157 - protein, 24 aa, Homo sapiens
  Native (EGFR L858R)
LAARNVLVKTPQHVKITDFGRAKL

SEQ ID NO: 23158 - protein, 25 aa, Homo sapiens
  Native (EGFR L858R)
LAARNVLVKTPQHVKITDFGRAKLL

SEQ ID NO: 23159 - protein, 16 aa, Homo sapiens
  Native (EGFR L858R)
LVKTPQHVKITDFGRA

SEQ ID NO: 23160 - protein, 17 aa, Homo sapiens
  Native (EGFR L858R)
LVKTPQHVKITDFGRAK

SEQ ID NO: 23161 - protein, 18 aa, Homo sapiens
  Native (EGFR L858R)
LVKTPQHVKITDFGRAKL

SEQ ID NO: 23162 - protein, 19 aa, Homo sapiens
  Native (EGFR L858R)
LVKTPQHVKITDFGRAKLL

SEQ ID NO: 23163 - protein, 20 aa, Homo sapiens
  Native (EGFR L858R)
LVKTPQHVKITDFGRAKLLG

SEQ ID NO: 23164 - protein, 21 aa, Homo sapiens
  Native (EGFR L858R)
LVKTPQHVKITDFGRAKLLGA

SEQ ID NO: 23165 - protein, 22 aa, Homo sapiens
  Native (EGFR L858R)
LVKTPQHVKITDFGRAKLLGAE

SEQ ID NO: 23166 - protein, 23 aa, Homo sapiens
  Native (EGFR L858R)
LVKTPQHVKITDFGRAKLLGAEE

SEQ ID NO: 23167 - protein, 24 aa, Homo sapiens
  Native (EGFR L858R)
LVKTPQHVKITDFGRAKLLGAEEK

SEQ ID NO: 23168 - protein, 25 aa, Homo sapiens
  Native (EGFR L858R)
LVKTPQHVKITDFGRAKLLGAEEKE

SEQ ID NO: 23169 - protein, 19 aa, Homo sapiens
  Native (EGFR L858R)
NVLVKTPQHVKITDFGRAK

SEQ ID NO: 23170 - protein, 20 aa, Homo sapiens
  Native (EGFR L858R)
NVLVKTPQHVKITDFGRAKL

SEQ ID NO: 23171 - protein, 21 aa, Homo sapiens
  Native (EGFR L858R)
NVLVKTPQHVKITDFGRAKLL

SEQ ID NO: 23172 - protein, 22 aa, Homo sapiens
  Native (EGFR L858R)
NVLVKTPQHVKITDFGRAKLLG

SEQ ID NO: 23173 - protein, 23 aa, Homo sapiens
  Native (EGFR L858R)
NVLVKTPQHVKITDFGRAKLLGA

SEQ ID NO: 23174 - protein, 24 aa, Homo sapiens
  Native (EGFR L858R)
NVLVKTPQHVKITDFGRAKLLGAE

SEQ ID NO: 23175 - protein, 25 aa, Homo sapiens
  Native (EGFR L858R)
NVLVKTPQHVKITDFGRAKLLGAEE

SEQ ID NO: 23176 - protein, 14 aa, Homo sapiens
  Native (EGFR L858R)
PQHVKITDFGRAKL

SEQ ID NO: 23177 - protein, 15 aa, Homo sapiens
  Native (EGFR L858R)
PQHVKITDFGRAKLL

SEQ ID NO: 23178 - protein, 16 aa, Homo sapiens
  Native (EGFR L858R)
PQHVKITDFGRAKLLG

SEQ ID NO: 23179 - protein, 17 aa, Homo sapiens
  Native (EGFR L858R)
PQHVKITDFGRAKLLGA

SEQ ID NO: 23180 - protein, 18 aa, Homo sapiens
  Native (EGFR L858R)
PQHVKITDFGRAKLLGAE

SEQ ID NO: 23181 - protein, 19 aa, Homo sapiens
  Native (EGFR L858R)
PQHVKITDFGRAKLLGAEE

SEQ ID NO: 23182 - protein, 20 aa, Homo sapiens
  Native (EGFR L858R)
PQHVKITDFGRAKLLGAEEK

SEQ ID NO: 23183 - protein, 21 aa, Homo sapiens
  Native (EGFR L858R)
PQHVKITDFGRAKLLGAEEKE

SEQ ID NO: 23184 - protein, 22 aa, Homo sapiens
  Native (EGFR L858R)
PQHVKITDFGRAKLLGAEEKEY

SEQ ID NO: 23185 - protein, 23 aa, Homo sapiens
  Native (EGFR L858R)
PQHVKITDFGRAKLLGAEEKEYH

SEQ ID NO: 23186 - protein, 24 aa, Homo sapiens
  Native (EGFR L858R)
PQHVKITDFGRAKLLGAEEKEYHA

SEQ ID NO: 23187 - protein, 25 aa, Homo sapiens
  Native (EGFR L858R)
PQHVKITDFGRAKLLGAEEKEYHAE

SEQ ID NO: 23188 - protein, 13 aa, Homo sapiens
  Native (EGFR L858R)
QHVKITDFGRAKL

SEQ ID NO: 23189 - protein, 14 aa, Homo sapiens
  Native (EGFR L858R)
QHVKITDFGRAKLL

SEQ ID NO: 23190 - protein, 15 aa, Homo sapiens
  Native (EGFR L858R)
QHVKITDFGRAKLLG

SEQ ID NO: 23191 - protein, 16 aa, Homo sapiens
  Native (EGFR L858R)
QHVKITDFGRAKLLGA

SEQ ID NO: 23192 - protein, 17 aa, Homo sapiens
  Native (EGFR L858R)
QHVKITDFGRAKLLGAE

SEQ ID NO: 23193 - protein, 18 aa, Homo sapiens
  Native (EGFR L858R)
QHVKITDFGRAKLLGAEE

SEQ ID NO: 23194 - protein, 19 aa, Homo sapiens
  Native (EGFR L858R)
QHVKITDFGRAKLLGAEEK

SEQ ID NO: 23195 - protein, 20 aa, Homo sapiens
  Native (EGFR L858R)
QHVKITDFGRAKLLGAEEKE

SEQ ID NO: 23196 - protein, 21 aa, Homo sapiens
  Native (EGFR L858R)
QHVKITDFGRAKLLGAEEKEY

SEQ ID NO: 23197 - protein, 22 aa, Homo sapiens
  Native (EGFR L858R)
QHVKITDFGRAKLLGAEEKEYH

SEQ ID NO: 23198 - protein, 23 aa, Homo sapiens
  Native (EGFR L858R)
QHVKITDFGRAKLLGAEEKEYHA

SEQ ID NO: 23199 - protein, 24 aa, Homo sapiens
  Native (EGFR L858R)
QHVKITDFGRAKLLGAEEKEYHAE

SEQ ID NO: 23200 - protein, 25 aa, Homo sapiens
  Native (EGFR L858R)
QHVKITDFGRAKLLGAEEKEYHAEG

SEQ ID NO: 23201 - protein, 25 aa, Homo sapiens
  Native (EGFR L858R)
RDLAARNVLVKTPQHVKITDFGRAK

SEQ ID NO: 23202 - protein, 19 aa, Homo sapiens
  Native (EGFR L858R)
RNVLVKTPQHVKITDFGRA

SEQ ID NO: 23203 - protein, 20 aa, Homo sapiens
  Native (EGFR L858R)
RNVLVKTPQHVKITDFGRAK

SEQ ID NO: 23204 - protein, 21 aa, Homo sapiens
  Native (EGFR L858R)
RNVLVKTPQHVKITDFGRAKL

SEQ ID NO: 23205 - protein, 22 aa, Homo sapiens
  Native (EGFR L858R)
RNVLVKTPQHVKITDFGRAKLL

SEQ ID NO: 23206 - protein, 23 aa, Homo sapiens
  Native (EGFR L858R)
RNVLVKTPQHVKITDFGRAKLLG

SEQ ID NO: 23207 - protein, 24 aa, Homo sapiens
  Native (EGFR L858R)
RNVLVKTPQHVKITDFGRAKLLGA

SEQ ID NO: 23208 - protein, 25 aa, Homo sapiens
  Native (EGFR L858R)
RNVLVKTPQHVKITDFGRAKLLGAE

SEQ ID NO: 23209 - protein, 14 aa, Homo sapiens
  Native (EGFR L858R)
TDFGRAKLLGAEEK

SEQ ID NO: 23210 - protein, 15 aa, Homo sapiens
  Native (EGFR L858R)
TDFGRAKLLGAEEKE

SEQ ID NO: 23211 - protein, 16 aa, Homo sapiens
  Native (EGFR L858R)
TDFGRAKLLGAEEKEY

SEQ ID NO: 23212 - protein, 17 aa, Homo sapiens
  Native (EGFR L858R)
TDFGRAKLLGAEEKEYH

SEQ ID NO: 23213 - protein, 18 aa, Homo sapiens
  Native (EGFR L858R)
TDFGRAKLLGAEEKEYHA

SEQ ID NO: 23214 - protein, 19 aa, Homo sapiens
  Native (EGFR L858R)
TDFGRAKLLGAEEKEYHAE

SEQ ID NO: 23215 - protein, 20 aa, Homo sapiens
  Native (EGFR L858R)
TDFGRAKLLGAEEKEYHAEG

SEQ ID NO: 23216 - protein, 21 aa, Homo sapiens
  Native (EGFR L858R)
TDFGRAKLLGAEEKEYHAEGG

SEQ ID NO: 23217 - protein, 22 aa, Homo sapiens
  Native (EGFR L858R)
TDFGRAKLLGAEEKEYHAEGGK

SEQ ID NO: 23218 - protein, 23 aa, Homo sapiens
  Native (EGFR L858R)
TDFGRAKLLGAEEKEYHAEGGKV

SEQ ID NO: 23219 - protein, 24 aa, Homo sapiens
  Native (EGFR L858R)
TDFGRAKLLGAEEKEYHAEGGKVP

SEQ ID NO: 23220 - protein, 25 aa, Homo sapiens
  Native (EGFR L858R)
TDFGRAKLLGAEEKEYHAEGGKVPI

SEQ ID NO: 23221 - protein, 14 aa, Homo sapiens
  Native (EGFR L858R)
TPQHVKITDFGRAK

SEQ ID NO: 23222 - protein, 15 aa, Homo sapiens
  Native (EGFR L858R)
TPQHVKITDFGRAKL

SEQ ID NO: 23223 - protein, 16 aa, Homo sapiens
  Native (EGFR L858R)
TPQHVKITDFGRAKLL

SEQ ID NO: 23224 - protein, 17 aa, Homo sapiens
  Native (EGFR L858R)
TPQHVKITDFGRAKLLG

SEQ ID NO: 23225 - protein, 18 aa, Homo sapiens
  Native (EGFR L858R)
TPQHVKITDFGRAKLLGA

SEQ ID NO: 23226 - protein, 19 aa, Homo sapiens
  Native (EGFR L858R)
TPQHVKITDFGRAKLLGAE

SEQ ID NO: 23227 - protein, 20 aa, Homo sapiens
  Native (EGFR L858R)
TPQHVKITDFGRAKLLGAEE

SEQ ID NO: 23228 - protein, 21 aa, Homo sapiens
  Native (EGFR L858R)
TPQHVKITDFGRAKLLGAEEK

SEQ ID NO: 23229 - protein, 22 aa, Homo sapiens
  Native (EGFR L858R)
TPQHVKITDFGRAKLLGAEEKE

SEQ ID NO: 23230 - protein, 23 aa, Homo sapiens
  Native (EGFR L858R)
TPQHVKITDFGRAKLLGAEEKEY

SEQ ID NO: 23231 - protein, 24 aa, Homo sapiens
  Native (EGFR L858R)
TPQHVKITDFGRAKLLGAEEKEYH

SEQ ID NO: 23232 - protein, 25 aa, Homo sapiens
  Native (EGFR L858R)
TPQHVKITDFGRAKLLGAEEKEYHA

SEQ ID NO: 23233 - protein, 14 aa, Homo sapiens
  Native (EGFR L858R)
VKITDFGRAKLLGA

SEQ ID NO: 23234 - protein, 15 aa, Homo sapiens
  Native (EGFR L858R)
VKITDFGRAKLLGAE

SEQ ID NO: 23235 - protein, 16 aa, Homo sapiens
  Native (EGFR L858R)
VKITDFGRAKLLGAEE

SEQ ID NO: 23236 - protein, 17 aa, Homo sapiens
  Native (EGFR L858R)
VKITDFGRAKLLGAEEK

SEQ ID NO: 23237 - protein, 18 aa, Homo sapiens
  Native (EGFR L858R)
VKITDFGRAKLLGAEEKE

SEQ ID NO: 23238 - protein, 19 aa, Homo sapiens
  Native (EGFR L858R)
VKITDFGRAKLLGAEEKEY

SEQ ID NO: 23239 - protein, 20 aa, Homo sapiens
  Native (EGFR L858R)
VKITDFGRAKLLGAEEKEYH

SEQ ID NO: 23240 - protein, 21 aa, Homo sapiens
  Native (EGFR L858R)
VKITDFGRAKLLGAEEKEYHA

SEQ ID NO: 23241 - protein, 22 aa, Homo sapiens
  Native (EGFR L858R)
VKITDFGRAKLLGAEEKEYHAE

SEQ ID NO: 23242 - protein, 23 aa, Homo sapiens
  Native (EGFR L858R)
VKITDFGRAKLLGAEEKEYHAEG

SEQ ID NO: 23243 - protein, 24 aa, Homo sapiens
  Native (EGFR L858R)
VKITDFGRAKLLGAEEKEYHAEGG

SEQ ID NO: 23244 - protein, 25 aa, Homo sapiens
  Native (EGFR L858R)
VKITDFGRAKLLGAEEKEYHAEGGK

SEQ ID NO: 23245 - protein, 15 aa, Homo sapiens
  Native (EGFR L858R)
VKTPQHVKITDFGRA

SEQ ID NO: 23246 - protein, 16 aa, Homo sapiens
  Native (EGFR L858R)
VKTPQHVKITDFGRAK

SEQ ID NO: 23247 - protein, 17 aa, Homo sapiens
  Native (EGFR L858R)
VKTPQHVKITDFGRAKL

SEQ ID NO: 23248 - protein, 18 aa, Homo sapiens
  Native (EGFR L858R)
VKTPQHVKITDFGRAKLL

SEQ ID NO: 23249 - protein, 19 aa, Homo sapiens
  Native (EGFR L858R)
VKTPQHVKITDFGRAKLLG

SEQ ID NO: 23250 - protein, 20 aa, Homo sapiens
  Native (EGFR L858R)
VKTPQHVKITDFGRAKLLGA

SEQ ID NO: 23251 - protein, 21 aa, Homo sapiens
  Native (EGFR L858R)
VKTPQHVKITDFGRAKLLGAE

SEQ ID NO: 23252 - protein, 22 aa, Homo sapiens
  Native (EGFR L858R)
VKTPQHVKITDFGRAKLLGAEE

SEQ ID NO: 23253 - protein, 23 aa, Homo sapiens
  Native (EGFR L858R)
VKTPQHVKITDFGRAKLLGAEEK

SEQ ID NO: 23254 - protein, 24 aa, Homo sapiens
  Native (EGFR L858R)
VKTPQHVKITDFGRAKLLGAEEKE

SEQ ID NO: 23255 - protein, 25 aa, Homo sapiens
  Native (EGFR L858R)
VKTPQHVKITDFGRAKLLGAEEKEY

SEQ ID NO: 23256 - protein, 17 aa, Homo sapiens
  Native (EGFR L858R)
VLVKTPQHVKITDFGRA

SEQ ID NO: 23257 - protein, 19 aa, Homo sapiens
  Native (EGFR L858R)
VLVKTPQHVKITDFGRAKL

SEQ ID NO: 23258 - protein, 20 aa, Homo sapiens
  Native (EGFR L858R)
VLVKTPQHVKITDFGRAKLL

SEQ ID NO: 23259 - protein, 21 aa, Homo sapiens
  Native (EGFR L858R)
VLVKTPQHVKITDFGRAKLLG

SEQ ID NO: 23260 - protein, 22 aa, Homo sapiens
  Native (EGFR L858R)
VLVKTPQHVKITDFGRAKLLGA

SEQ ID NO: 23261 - protein, 23 aa, Homo sapiens
  Native (EGFR L858R)
VLVKTPQHVKITDFGRAKLLGAE

SEQ ID NO: 23262 - protein, 24 aa, Homo sapiens
  Native (EGFR L858R)
VLVKTPQHVKITDFGRAKLLGAEE

SEQ ID NO: 23263 - protein, 25 aa, Homo sapiens
  Native (EGFR L858R)
VLVKTPQHVKITDFGRAKLLGAEEK

SEQ ID NO: 23264 - protein, 24 aa, Homo sapiens
  Native (GTF2I L424H)
EGIPFRRPSTYGIPRLERILHAKE

SEQ ID NO: 23265 - protein, 25 aa, Homo sapiens
  Native (GTF2I L424H)
EGIPFRRPSTYGIPRLERILHAKER

SEQ ID NO: 23266 - protein, 13 aa, Homo sapiens
  Native (GTF2I L424H)
ERILHAKERIRFV

SEQ ID NO: 23267 - protein, 14 aa, Homo sapiens
  Native (GTF2I L424H)
ERILHAKERIRFVI

SEQ ID NO: 23268 - protein, 15 aa, Homo sapiens
  Native (GTF2I L424H)
ERILHAKERIRFVIK

SEQ ID NO: 23269 - protein, 16 aa, Homo sapiens
  Native (GTF2I L424H)
ERILHAKERIRFVIKK

SEQ ID NO: 23270 - protein, 17 aa, Homo sapiens
  Native (GTF2I L424H)
ERILHAKERIRFVIKKH

SEQ ID NO: 23271 - protein, 18 aa, Homo sapiens
  Native (GTF2I L424H)
ERILHAKERIRFVIKKHE

SEQ ID NO: 23272 - protein, 19 aa, Homo sapiens
  Native (GTF2I L424H)
ERILHAKERIRFVIKKHEL

SEQ ID NO: 23273 - protein, 20 aa, Homo sapiens
  Native (GTF2I L424H)
ERILHAKERIRFVIKKHELL

SEQ ID NO: 23274 - protein, 20 aa, Homo sapiens
  Native (GTF2I L424H)
FRRPSTYGIPRLERILHAKE

SEQ ID NO: 23275 - protein, 21 aa, Homo sapiens
  Native (GTF2I L424H)
FRRPSTYGIPRLERILHAKER

SEQ ID NO: 23276 - protein, 22 aa, Homo sapiens
  Native (GTF2I L424H)
FRRPSTYGIPRLERILHAKERI

SEQ ID NO: 23277 - protein, 23 aa, Homo sapiens
  Native (GTF2I L424H)
FRRPSTYGIPRLERILHAKERIR

SEQ ID NO: 23278 - protein, 24 aa, Homo sapiens
  Native (GTF2I L424H)
FRRPSTYGIPRLERILHAKERIRF

SEQ ID NO: 23279 - protein, 25 aa, Homo sapiens
  Native (GTF2I L424H)
FRRPSTYGIPRLERILHAKERIRFV

SEQ ID NO: 23280 - protein, 23 aa, Homo sapiens
  Native (GTF2I L424H)
GIPFRRPSTYGIPRLERILHAKE

SEQ ID NO: 23281 - protein, 24 aa, Homo sapiens
  Native (GTF2I L424H)
GIPFRRPSTYGIPRLERILHAKER

SEQ ID NO: 23282 - protein, 25 aa, Homo sapiens
  Native (GTF2I L424H)
GIPFRRPSTYGIPRLERILHAKERI

SEQ ID NO: 23283 - protein, 14 aa, Homo sapiens
  Native (GTF2I L424H)
GIPRLERILHAKER

SEQ ID NO: 23284 - protein, 15 aa, Homo sapiens
  Native (GTF2I L424H)
GIPRLERILHAKERI

SEQ ID NO: 23285 - protein, 16 aa, Homo sapiens
  Native (GTF2I L424H)
GIPRLERILHAKERIR

SEQ ID NO: 23286 - protein, 17 aa, Homo sapiens
  Native (GTF2I L424H)
GIPRLERILHAKERIRF

SEQ ID NO: 23287 - protein, 18 aa, Homo sapiens
  Native (GTF2I L424H)
GIPRLERILHAKERIRFV

SEQ ID NO: 23288 - protein, 19 aa, Homo sapiens
  Native (GTF2I L424H)
GIPRLERILHAKERIRFVI

SEQ ID NO: 23289 - protein, 20 aa, Homo sapiens
  Native (GTF2I L424H)
GIPRLERILHAKERIRFVIK

SEQ ID NO: 23290 - protein, 21 aa, Homo sapiens
  Native (GTF2I L424H)
GIPRLERILHAKERIRFVIKK

SEQ ID NO: 23291 - protein, 22 aa, Homo sapiens
  Native (GTF2I L424H)
GIPRLERILHAKERIRFVIKKH

SEQ ID NO: 23292 - protein, 23 aa, Homo sapiens
  Native (GTF2I L424H)
GIPRLERILHAKERIRFVIKKHE

SEQ ID NO: 23293 - protein, 24 aa, Homo sapiens
  Native (GTF2I L424H)
GIPRLERILHAKERIRFVIKKHEL

SEQ ID NO: 23294 - protein, 25 aa, Homo sapiens
  Native (GTF2I L424H)
GIPRLERILHAKERIRFVIKKHELL

SEQ ID NO: 23295 - protein, 13 aa, Homo sapiens
  Native (GTF2I L424H)
ILHAKERIRFVIK

SEQ ID NO: 23296 - protein, 14 aa, Homo sapiens
  Native (GTF2I L424H)
ILHAKERIRFVIKK

SEQ ID NO: 23297 - protein, 15 aa, Homo sapiens
  Native (GTF2I L424H)
ILHAKERIRFVIKKH

SEQ ID NO: 23298 - protein, 22 aa, Homo sapiens
  Native (GTF2I L424H)
IPFRRPSTYGIPRLERILHAKE

SEQ ID NO: 23299 - protein, 23 aa, Homo sapiens
  Native (GTF2I L424H)
IPFRRPSTYGIPRLERILHAKER

SEQ ID NO: 23300 - protein, 24 aa, Homo sapiens
  Native (GTF2I L424H)
IPFRRPSTYGIPRLERILHAKERI

SEQ ID NO: 23301 - protein, 25 aa, Homo sapiens
  Native (GTF2I L424H)
IPFRRPSTYGIPRLERILHAKERIR

SEQ ID NO: 23302 - protein, 15 aa, Homo sapiens
  Native (GTF2I L424H)
IPRLERILHAKERIR

SEQ ID NO: 23303 - protein, 16 aa, Homo sapiens
  Native (GTF2I L424H)
IPRLERILHAKERIRF

SEQ ID NO: 23304 - protein, 17 aa, Homo sapiens
  Native (GTF2I L424H)
IPRLERILHAKERIRFV

SEQ ID NO: 23305 - protein, 18 aa, Homo sapiens
  Native (GTF2I L424H)
IPRLERILHAKERIRFVI

SEQ ID NO: 23306 - protein, 19 aa, Homo sapiens
  Native (GTF2I L424H)
IPRLERILHAKERIRFVIK

SEQ ID NO: 23307 - protein, 20 aa, Homo sapiens
  Native (GTF2I L424H)
IPRLERILHAKERIRFVIKK

SEQ ID NO: 23308 - protein, 21 aa, Homo sapiens
  Native (GTF2I L424H)
IPRLERILHAKERIRFVIKKH

SEQ ID NO: 23309 - protein, 22 aa, Homo sapiens
  Native (GTF2I L424H)
IPRLERILHAKERIRFVIKKHE

SEQ ID NO: 23310 - protein, 23 aa, Homo sapiens
  Native (GTF2I L424H)
IPRLERILHAKERIRFVIKKHEL

SEQ ID NO: 23311 - protein, 24 aa, Homo sapiens
  Native (GTF2I L424H)
IPRLERILHAKERIRFVIKKHELL

SEQ ID NO: 23312 - protein, 25 aa, Homo sapiens
  Native (GTF2I L424H)
IPRLERILHAKERIRFVIKKHELLN

SEQ ID NO: 23313 - protein, 13 aa, Homo sapiens
  Native (GTF2I L424H)
LERILHAKERIRF

SEQ ID NO: 23314 - protein, 14 aa, Homo sapiens
  Native (GTF2I L424H)
LERILHAKERIRFV

SEQ ID NO: 23315 - protein, 15 aa, Homo sapiens
  Native (GTF2I L424H)
LERILHAKERIRFVI

SEQ ID NO: 23316 - protein, 16 aa, Homo sapiens
  Native (GTF2I L424H)
LERILHAKERIRFVIK

SEQ ID NO: 23317 - protein, 17 aa, Homo sapiens
  Native (GTF2I L424H)
LERILHAKERIRFVIKK

SEQ ID NO: 23318 - protein, 18 aa, Homo sapiens
  Native (GTF2I L424H)
LERILHAKERIRFVIKKH

SEQ ID NO: 23319 - protein, 19 aa, Homo sapiens
  Native (GTF2I L424H)
LERILHAKERIRFVIKKHE

SEQ ID NO: 23320 - protein, 20 aa, Homo sapiens
  Native (GTF2I L424H)
LERILHAKERIRFVIKKHEL

SEQ ID NO: 23321 - protein, 21 aa, Homo sapiens
  Native (GTF2I L424H)
LERILHAKERIRFVIKKHELL

SEQ ID NO: 23322 - protein, 23 aa, Homo sapiens
  Native (GTF2I L424H)
LERILHAKERIRFVIKKHELLNS

SEQ ID NO: 23323 - protein, 25 aa, Homo sapiens
  Native (GTF2I L424H)
PEGIPFRRPSTYGIPRLERILHAKE

SEQ ID NO: 23324 - protein, 21 aa, Homo sapiens
  Native (GTF2I L424H)
PFRRPSTYGIPRLERILHAKE

SEQ ID NO: 23325 - protein, 22 aa, Homo sapiens
  Native (GTF2I L424H)
PFRRPSTYGIPRLERILHAKER

SEQ ID NO: 23326 - protein, 23 aa, Homo sapiens
  Native (GTF2I L424H)
PFRRPSTYGIPRLERILHAKERI

SEQ ID NO: 23327 - protein, 24 aa, Homo sapiens
  Native (GTF2I L424H)
PFRRPSTYGIPRLERILHAKERIR

SEQ ID NO: 23328 - protein, 25 aa, Homo sapiens
  Native (GTF2I L424H)
PFRRPSTYGIPRLERILHAKERIRF

SEQ ID NO: 23329 - protein, 14 aa, Homo sapiens
  Native (GTF2I L424H)
PRLERILHAKERIR

SEQ ID NO: 23330 - protein, 15 aa, Homo sapiens
  Native (GTF2I L424H)
PRLERILHAKERIRF

SEQ ID NO: 23331 - protein, 16 aa, Homo sapiens
  Native (GTF2I L424H)
PRLERILHAKERIRFV

SEQ ID NO: 23332 - protein, 17 aa, Homo sapiens
  Native (GTF2I L424H)
PRLERILHAKERIRFVI

SEQ ID NO: 23333 - protein, 18 aa, Homo sapiens
  Native (GTF2I L424H)
PRLERILHAKERIRFVIK

SEQ ID NO: 23334 - protein, 19 aa, Homo sapiens
  Native (GTF2I L424H)
PRLERILHAKERIRFVIKK

SEQ ID NO: 23335 - protein, 20 aa, Homo sapiens
  Native (GTF2I L424H)
PRLERILHAKERIRFVIKKH

SEQ ID NO: 23336 - protein, 21 aa, Homo sapiens
  Native (GTF2I L424H)
PRLERILHAKERIRFVIKKHE

SEQ ID NO: 23337 - protein, 22 aa, Homo sapiens
  Native (GTF2I L424H)
PRLERILHAKERIRFVIKKHEL

SEQ ID NO: 23338 - protein, 23 aa, Homo sapiens
  Native (GTF2I L424H)
PRLERILHAKERIRFVIKKHELL

SEQ ID NO: 23339 - protein, 24 aa, Homo sapiens
  Native (GTF2I L424H)
PRLERILHAKERIRFVIKKHELLN

SEQ ID NO: 23340 - protein, 25 aa, Homo sapiens
  Native (GTF2I L424H)
PRLERILHAKERIRFVIKKHELLNS

SEQ ID NO: 23341 - protein, 15 aa, Homo sapiens
  Native (GTF2I L424H)
PSTYGIPRLERILHA

SEQ ID NO: 23342 - protein, 17 aa, Homo sapiens
  Native (GTF2I L424H)
PSTYGIPRLERILHAKE

SEQ ID NO: 23343 - protein, 18 aa, Homo sapiens
  Native (GTF2I L424H)
PSTYGIPRLERILHAKER

SEQ ID NO: 23344 - protein, 19 aa, Homo sapiens
  Native (GTF2I L424H)
PSTYGIPRLERILHAKERI

SEQ ID NO: 23345 - protein, 20 aa, Homo sapiens
  Native (GTF2I L424H)
PSTYGIPRLERILHAKERIR

SEQ ID NO: 23346 - protein, 21 aa, Homo sapiens
  Native (GTF2I L424H)
PSTYGIPRLERILHAKERIRF

SEQ ID NO: 23347 - protein, 22 aa, Homo sapiens
  Native (GTF2I L424H)
PSTYGIPRLERILHAKERIRFV

SEQ ID NO: 23348 - protein, 23 aa, Homo sapiens
  Native (GTF2I L424H)
PSTYGIPRLERILHAKERIRFVI

SEQ ID NO: 23349 - protein, 24 aa, Homo sapiens
  Native (GTF2I L424H)
PSTYGIPRLERILHAKERIRFVIK

SEQ ID NO: 23350 - protein, 25 aa, Homo sapiens
  Native (GTF2I L424H)
PSTYGIPRLERILHAKERIRFVIKK

SEQ ID NO: 23351 - protein, 13 aa, Homo sapiens
  Native (GTF2I L424H)
RILHAKERIRFVI

SEQ ID NO: 23352 - protein, 14 aa, Homo sapiens
  Native (GTF2I L424H)
RILHAKERIRFVIK

SEQ ID NO: 23353 - protein, 15 aa, Homo sapiens
  Native (GTF2I L424H)
RILHAKERIRFVIKK

SEQ ID NO: 23354 - protein, 16 aa, Homo sapiens
  Native (GTF2I L424H)
RILHAKERIRFVIKKH

SEQ ID NO: 23355 - protein, 17 aa, Homo sapiens
  Native (GTF2I L424H)
RILHAKERIRFVIKKHE

SEQ ID NO: 23356 - protein, 14 aa, Homo sapiens
  Native (GTF2I L424H)
RLERILHAKERIRF

SEQ ID NO: 23357 - protein, 15 aa, Homo sapiens
  Native (GTF2I L424H)
RLERILHAKERIRFV

SEQ ID NO: 23358 - protein, 16 aa, Homo sapiens
  Native (GTF2I L424H)
RLERILHAKERIRFVI

SEQ ID NO: 23359 - protein, 17 aa, Homo sapiens
  Native (GTF2I L424H)
RLERILHAKERIRFVIK

SEQ ID NO: 23360 - protein, 18 aa, Homo sapiens
  Native (GTF2I L424H)
RLERILHAKERIRFVIKK

SEQ ID NO: 23361 - protein, 19 aa, Homo sapiens
  Native (GTF2I L424H)
RLERILHAKERIRFVIKKH

SEQ ID NO: 23362 - protein, 20 aa, Homo sapiens
  Native (GTF2I L424H)
RLERILHAKERIRFVIKKHE

SEQ ID NO: 23363 - protein, 21 aa, Homo sapiens
  Native (GTF2I L424H)
RLERILHAKERIRFVIKKHEL

SEQ ID NO: 23364 - protein, 22 aa, Homo sapiens
  Native (GTF2I L424H)
RLERILHAKERIRFVIKKHELL

SEQ ID NO: 23365 - protein, 23 aa, Homo sapiens
  Native (GTF2I L424H)
RLERILHAKERIRFVIKKHELLN

SEQ ID NO: 23366 - protein, 24 aa, Homo sapiens
  Native (GTF2I L424H)
RLERILHAKERIRFVIKKHELLNS

SEQ ID NO: 23367 - protein, 19 aa, Homo sapiens
  Native (GTF2I L424H)
RPSTYGIPRLERILHAKER

SEQ ID NO: 23368 - protein, 20 aa, Homo sapiens
  Native (GTF2I L424H)
RPSTYGIPRLERILHAKERI

SEQ ID NO: 23369 - protein, 21 aa, Homo sapiens
  Native (GTF2I L424H)
RPSTYGIPRLERILHAKERIR

SEQ ID NO: 23370 - protein, 22 aa, Homo sapiens
  Native (GTF2I L424H)
RPSTYGIPRLERILHAKERIRF

SEQ ID NO: 23371 - protein, 23 aa, Homo sapiens
  Native (GTF2I L424H)
RPSTYGIPRLERILHAKERIRFV

SEQ ID NO: 23372 - protein, 24 aa, Homo sapiens
  Native (GTF2I L424H)
RPSTYGIPRLERILHAKERIRFVI

SEQ ID NO: 23373 - protein, 25 aa, Homo sapiens
  Native (GTF2I L424H)
RPSTYGIPRLERILHAKERIRFVIK

SEQ ID NO: 23374 - protein, 19 aa, Homo sapiens
  Native (GTF2I L424H)
RRPSTYGIPRLERILHAKE

SEQ ID NO: 23375 - protein, 20 aa, Homo sapiens
  Native (GTF2I L424H)
RRPSTYGIPRLERILHAKER

SEQ ID NO: 23376 - protein, 21 aa, Homo sapiens
  Native (GTF2I L424H)
RRPSTYGIPRLERILHAKERI

SEQ ID NO: 23377 - protein, 22 aa, Homo sapiens
  Native (GTF2I L424H)
RRPSTYGIPRLERILHAKERIR

SEQ ID NO: 23378 - protein, 23 aa, Homo sapiens
  Native (GTF2I L424H)
RRPSTYGIPRLERILHAKERIRF

SEQ ID NO: 23379 - protein, 24 aa, Homo sapiens
  Native (GTF2I L424H)
RRPSTYGIPRLERILHAKERIRFV

SEQ ID NO: 23380 - protein, 25 aa, Homo sapiens
  Native (GTF2I L424H)
RRPSTYGIPRLERILHAKERIRFVI

SEQ ID NO: 23381 - protein, 15 aa, Homo sapiens
  Native (GTF2I L424H)
STYGIPRLERILHAK

SEQ ID NO: 23382 - protein, 16 aa, Homo sapiens
  Native (GTF2I L424H)
STYGIPRLERILHAKE

SEQ ID NO: 23383 - protein, 17 aa, Homo sapiens
  Native (GTF2I L424H)
STYGIPRLERILHAKER

SEQ ID NO: 23384 - protein, 18 aa, Homo sapiens
  Native (GTF2I L424H)
STYGIPRLERILHAKERI

SEQ ID NO: 23385 - protein, 19 aa, Homo sapiens
  Native (GTF2I L424H)
STYGIPRLERILHAKERIR

SEQ ID NO: 23386 - protein, 20 aa, Homo sapiens
  Native (GTF2I L424H)
STYGIPRLERILHAKERIRF

SEQ ID NO: 23387 - protein, 21 aa, Homo sapiens
  Native (GTF2I L424H)
STYGIPRLERILHAKERIRFV

SEQ ID NO: 23388 - protein, 22 aa, Homo sapiens
  Native (GTF2I L424H)
STYGIPRLERILHAKERIRFVI

SEQ ID NO: 23389 - protein, 23 aa, Homo sapiens
  Native (GTF2I L424H)
STYGIPRLERILHAKERIRFVIK

SEQ ID NO: 23390 - protein, 24 aa, Homo sapiens
  Native (GTF2I L424H)
STYGIPRLERILHAKERIRFVIKK

SEQ ID NO: 23391 - protein, 25 aa, Homo sapiens
  Native (GTF2I L424H)
STYGIPRLERILHAKERIRFVIKKH

SEQ ID NO: 23392 - protein, 14 aa, Homo sapiens
  Native (GTF2I L424H)
TYGIPRLERILHAK

SEQ ID NO: 23393 - protein, 15 aa, Homo sapiens
  Native (GTF2I L424H)
TYGIPRLERILHAKE

SEQ ID NO: 23394 - protein, 16 aa, Homo sapiens
  Native (GTF2I L424H)
TYGIPRLERILHAKER

SEQ ID NO: 23395 - protein, 17 aa, Homo sapiens
  Native (GTF2I L424H)
TYGIPRLERILHAKERI

SEQ ID NO: 23396 - protein, 18 aa, Homo sapiens
  Native (GTF2I L424H)
TYGIPRLERILHAKERIR

SEQ ID NO: 23397 - protein, 19 aa, Homo sapiens
  Native (GTF2I L424H)
TYGIPRLERILHAKERIRF

SEQ ID NO: 23398 - protein, 20 aa, Homo sapiens
  Native (GTF2I L424H)
TYGIPRLERILHAKERIRFV

SEQ ID NO: 23399 - protein, 21 aa, Homo sapiens
  Native (GTF2I L424H)
TYGIPRLERILHAKERIRFVI

SEQ ID NO: 23400 - protein, 22 aa, Homo sapiens
  Native (GTF2I L424H)
TYGIPRLERILHAKERIRFVIK

SEQ ID NO: 23401 - protein, 23 aa, Homo sapiens
  Native (GTF2I L424H)
TYGIPRLERILHAKERIRFVIKK

SEQ ID NO: 23402 - protein, 24 aa, Homo sapiens
  Native (GTF2I L424H)
TYGIPRLERILHAKERIRFVIKKH

SEQ ID NO: 23403 - protein, 25 aa, Homo sapiens
  Native (GTF2I L424H)
TYGIPRLERILHAKERIRFVIKKHE

SEQ ID NO: 23404 - protein, 14 aa, Homo sapiens
  Native (GTF2I L424H)
YGIPRLERILHAKE

SEQ ID NO: 23405 - protein, 15 aa, Homo sapiens
  Native (GTF2I L424H)
YGIPRLERILHAKER

SEQ ID NO: 23406 - protein, 16 aa, Homo sapiens
  Native (GTF2I L424H)
YGIPRLERILHAKERI

SEQ ID NO: 23407 - protein, 17 aa, Homo sapiens
  Native (GTF2I L424H)
YGIPRLERILHAKERIR

SEQ ID NO: 23408 - protein, 18 aa, Homo sapiens
  Native (GTF2I L424H)
YGIPRLERILHAKERIRF

SEQ ID NO: 23409 - protein, 19 aa, Homo sapiens
  Native (GTF2I L424H)
YGIPRLERILHAKERIRFV

SEQ ID NO: 23410 - protein, 20 aa, Homo sapiens
  Native (GTF2I L424H)
YGIPRLERILHAKERIRFVI

SEQ ID NO: 23411 - protein, 21 aa, Homo sapiens
  Native (GTF2I L424H)
YGIPRLERILHAKERIRFVIK

SEQ ID NO: 23412 - protein, 22 aa, Homo sapiens
  Native (GTF2I L424H)
YGIPRLERILHAKERIRFVIKK

SEQ ID NO: 23413 - protein, 23 aa, Homo sapiens
  Native (GTF2I L424H)
YGIPRLERILHAKERIRFVIKKH

SEQ ID NO: 23414 - protein, 24 aa, Homo sapiens
  Native (GTF2I L424H)
YGIPRLERILHAKERIRFVIKKHE

SEQ ID NO: 23415 - protein, 25 aa, Homo sapiens
  Native (GTF2I L424H)
YGIPRLERILHAKERIRFVIKKHEL

SEQ ID NO: 23416 - protein, 24 aa, Homo sapiens
  Native (IDH1 R132C)
CKNIPRLVSGWVKPIIIGCHAYGD

SEQ ID NO: 23417 - protein, 25 aa, Homo sapiens
  Native (IDH1 R132C)
CKNIPRLVSGWVKPIIIGCHAYGDQ

SEQ ID NO: 23418 - protein, 15 aa, Homo sapiens
  Native (IDH1 R132C)
GWVKPIIIGCHAYGD

SEQ ID NO: 23419 - protein, 16 aa, Homo sapiens
  Native (IDH1 R132C)
GWVKPIIIGCHAYGDQ

SEQ ID NO: 23420 - protein, 17 aa, Homo sapiens
  Native (IDH1 R132C)
GWVKPIIIGCHAYGDQY

SEQ ID NO: 23421 - protein, 19 aa, Homo sapiens
  Native (IDH1 R132C)
GWVKPIIIGCHAYGDQYRA

SEQ ID NO: 23422 - protein, 20 aa, Homo sapiens
  Native (IDH1 R132C)
GWVKPIIIGCHAYGDQYRAT

SEQ ID NO: 23423 - protein, 21 aa, Homo sapiens
  Native (IDH1 R132C)
GWVKPIIIGCHAYGDQYRATD

SEQ ID NO: 23424 - protein, 22 aa, Homo sapiens
  Native (IDH1 R132C)
GWVKPIIIGCHAYGDQYRATDF

SEQ ID NO: 23425 - protein, 23 aa, Homo sapiens
  Native (IDH1 R132C)
GWVKPIIIGCHAYGDQYRATDFV

SEQ ID NO: 23426 - protein, 24 aa, Homo sapiens
  Native (IDH1 R132C)
GWVKPIIIGCHAYGDQYRATDFVV

SEQ ID NO: 23427 - protein, 25 aa, Homo sapiens
  Native (IDH1 R132C)
GWVKPIIIGCHAYGDQYRATDFVVP

SEQ ID NO: 23428 - protein, 25 aa, Homo sapiens
  Native (IDH1 R132C)
ICKNIPRLVSGWVKPIIIGCHAYGD

SEQ ID NO: 23429 - protein, 25 aa, Homo sapiens
  Native (IDH1 R132C)
IICKNIPRLVSGWVKPIIIGCHAYG

SEQ ID NO: 23430 - protein, 20 aa, Homo sapiens
  Native (IDH1 R132C)
IPRLVSGWVKPIIIGCHAYG

SEQ ID NO: 23431 - protein, 21 aa, Homo sapiens
  Native (IDH1 R132C)
IPRLVSGWVKPIIIGCHAYGD

SEQ ID NO: 23432 - protein, 22 aa, Homo sapiens
  Native (IDH1 R132C)
IPRLVSGWVKPIIIGCHAYGDQ

SEQ ID NO: 23433 - protein, 23 aa, Homo sapiens
  Native (IDH1 R132C)
IPRLVSGWVKPIIIGCHAYGDQY

SEQ ID NO: 23434 - protein, 24 aa, Homo sapiens
  Native (IDH1 R132C)
IPRLVSGWVKPIIIGCHAYGDQYR

SEQ ID NO: 23435 - protein, 25 aa, Homo sapiens
  Native (IDH1 R132C)
IPRLVSGWVKPIIIGCHAYGDQYRA

SEQ ID NO: 23436 - protein, 23 aa, Homo sapiens
  Native (IDH1 R132C)
KNIPRLVSGWVKPIIIGCHAYGD

SEQ ID NO: 23437 - protein, 24 aa, Homo sapiens
  Native (IDH1 R132C)
KNIPRLVSGWVKPIIIGCHAYGDQ

SEQ ID NO: 23438 - protein, 25 aa, Homo sapiens
  Native (IDH1 R132C)
KNIPRLVSGWVKPIIIGCHAYGDQY

SEQ ID NO: 23439 - protein, 15 aa, Homo sapiens
  Native (IDH1 R132C)
KPIIIGCHAYGDQYR

SEQ ID NO: 23440 - protein, 14 aa, Homo sapiens
  Native (IDH1 R132C)
LVSGWVKPIIIGCH

SEQ ID NO: 23441 - protein, 15 aa, Homo sapiens
  Native (IDH1 R132C)
LVSGWVKPIIIGCHA

SEQ ID NO: 23442 - protein, 16 aa, Homo sapiens
  Native (IDH1 R132C)
LVSGWVKPIIIGCHAY

SEQ ID NO: 23443 - protein, 17 aa, Homo sapiens
  Native (IDH1 R132C)
LVSGWVKPIIIGCHAYG

SEQ ID NO: 23444 - protein, 19 aa, Homo sapiens
  Native (IDH1 R132C)
LVSGWVKPIIIGCHAYGDQ

SEQ ID NO: 23445 - protein, 20 aa, Homo sapiens
  Native (IDH1 R132C)
LVSGWVKPIIIGCHAYGDQY

SEQ ID NO: 23446 - protein, 21 aa, Homo sapiens
  Native (IDH1 R132C)
LVSGWVKPIIIGCHAYGDQYR

SEQ ID NO: 23447 - protein, 22 aa, Homo sapiens
  Native (IDH1 R132C)
LVSGWVKPIIIGCHAYGDQYRA

SEQ ID NO: 23448 - protein, 23 aa, Homo sapiens
  Native (IDH1 R132C)
LVSGWVKPIIIGCHAYGDQYRAT

SEQ ID NO: 23449 - protein, 24 aa, Homo sapiens
  Native (IDH1 R132C)
LVSGWVKPIIIGCHAYGDQYRATD

SEQ ID NO: 23450 - protein, 25 aa, Homo sapiens
  Native (IDH1 R132C)
LVSGWVKPIIIGCHAYGDQYRATDF

SEQ ID NO: 23451 - protein, 22 aa, Homo sapiens
  Native (IDH1 R132C)
NIPRLVSGWVKPIIIGCHAYGD

SEQ ID NO: 23452 - protein, 23 aa, Homo sapiens
  Native (IDH1 R132C)
NIPRLVSGWVKPIIIGCHAYGDQ

SEQ ID NO: 23453 - protein, 24 aa, Homo sapiens
  Native (IDH1 R132C)
NIPRLVSGWVKPIIIGCHAYGDQY

SEQ ID NO: 23454 - protein, 25 aa, Homo sapiens
  Native (IDH1 R132C)
NIPRLVSGWVKPIIIGCHAYGDQYR

SEQ ID NO: 23455 - protein, 19 aa, Homo sapiens
  Native (IDH1 R132C)
PRLVSGWVKPIIIGCHAYG

SEQ ID NO: 23456 - protein, 20 aa, Homo sapiens
  Native (IDH1 R132C)
PRLVSGWVKPIIIGCHAYGD

SEQ ID NO: 23457 - protein, 21 aa, Homo sapiens
  Native (IDH1 R132C)
PRLVSGWVKPIIIGCHAYGDQ

SEQ ID NO: 23458 - protein, 22 aa, Homo sapiens
  Native (IDH1 R132C)
PRLVSGWVKPIIIGCHAYGDQY

SEQ ID NO: 23459 - protein, 23 aa, Homo sapiens
  Native (IDH1 R132C)
PRLVSGWVKPIIIGCHAYGDQYR

SEQ ID NO: 23460 - protein, 24 aa, Homo sapiens
  Native (IDH1 R132C)
PRLVSGWVKPIIIGCHAYGDQYRA

SEQ ID NO: 23461 - protein, 25 aa, Homo sapiens
  Native (IDH1 R132C)
PRLVSGWVKPIIIGCHAYGDQYRAT

SEQ ID NO: 23462 - protein, 16 aa, Homo sapiens
  Native (IDH1 R132C)
RLVSGWVKPIIIGCHA

SEQ ID NO: 23463 - protein, 17 aa, Homo sapiens
  Native (IDH1 R132C)
RLVSGWVKPIIIGCHAY

SEQ ID NO: 23464 - protein, 18 aa, Homo sapiens
  Native (IDH1 R132C)
RLVSGWVKPIIIGCHAYG

SEQ ID NO: 23465 - protein, 19 aa, Homo sapiens
  Native (IDH1 R132C)
RLVSGWVKPIIIGCHAYGD

SEQ ID NO: 23466 - protein, 20 aa, Homo sapiens
  Native (IDH1 R132C)
RLVSGWVKPIIIGCHAYGDQ

SEQ ID NO: 23467 - protein, 21 aa, Homo sapiens
  Native (IDH1 R132C)
RLVSGWVKPIIIGCHAYGDQY

SEQ ID NO: 23468 - protein, 22 aa, Homo sapiens
  Native (IDH1 R132C)
RLVSGWVKPIIIGCHAYGDQYR

SEQ ID NO: 23469 - protein, 23 aa, Homo sapiens
  Native (IDH1 R132C)
RLVSGWVKPIIIGCHAYGDQYRA

SEQ ID NO: 23470 - protein, 24 aa, Homo sapiens
  Native (IDH1 R132C)
RLVSGWVKPIIIGCHAYGDQYRAT

SEQ ID NO: 23471 - protein, 25 aa, Homo sapiens
  Native (IDH1 R132C)
RLVSGWVKPIIIGCHAYGDQYRATD

SEQ ID NO: 23472 - protein, 15 aa, Homo sapiens
  Native (IDH1 R132C)
SGWVKPIIIGCHAYG

SEQ ID NO: 23473 - protein, 16 aa, Homo sapiens
  Native (IDH1 R132C)
SGWVKPIIIGCHAYGD

SEQ ID NO: 23474 - protein, 17 aa, Homo sapiens
  Native (IDH1 R132C)
SGWVKPIIIGCHAYGDQ

SEQ ID NO: 23475 - protein, 19 aa, Homo sapiens
  Native (IDH1 R132C)
SGWVKPIIIGCHAYGDQYR

SEQ ID NO: 23476 - protein, 20 aa, Homo sapiens
  Native (IDH1 R132C)
SGWVKPIIIGCHAYGDQYRA

SEQ ID NO: 23477 - protein, 21 aa, Homo sapiens
  Native (IDH1 R132C)
SGWVKPIIIGCHAYGDQYRAT

SEQ ID NO: 23478 - protein, 22 aa, Homo sapiens
  Native (IDH1 R132C)
SGWVKPIIIGCHAYGDQYRATD

SEQ ID NO: 23479 - protein, 23 aa, Homo sapiens
  Native (IDH1 R132C)
SGWVKPIIIGCHAYGDQYRATDF

SEQ ID NO: 23480 - protein, 24 aa, Homo sapiens
  Native (IDH1 R132C)
SGWVKPIIIGCHAYGDQYRATDFV

SEQ ID NO: 23481 - protein, 25 aa, Homo sapiens
  Native (IDH1 R132C)
SGWVKPIIIGCHAYGDQYRATDFVV

SEQ ID NO: 23482 - protein, 15 aa, Homo sapiens
  Native (IDH1 R132C)
VKPIIIGCHAYGDQY

SEQ ID NO: 23483 - protein, 16 aa, Homo sapiens
  Native (IDH1 R132C)
VKPIIIGCHAYGDQYR

SEQ ID NO: 23484 - protein, 17 aa, Homo sapiens
  Native (IDH1 R132C)
VKPIIIGCHAYGDQYRA

SEQ ID NO: 23485 - protein, 15 aa, Homo sapiens
  Native (IDH1 R132C)
VSGWVKPIIIGCHAY

SEQ ID NO: 23486 - protein, 16 aa, Homo sapiens
  Native (IDH1 R132C)
VSGWVKPIIIGCHAYG

SEQ ID NO: 23487 - protein, 17 aa, Homo sapiens
  Native (IDH1 R132C)
VSGWVKPIIIGCHAYGD

SEQ ID NO: 23488 - protein, 19 aa, Homo sapiens
  Native (IDH1 R132C)
VSGWVKPIIIGCHAYGDQY

SEQ ID NO: 23489 - protein, 20 aa, Homo sapiens
  Native (IDH1 R132C)
VSGWVKPIIIGCHAYGDQYR

SEQ ID NO: 23490 - protein, 21 aa, Homo sapiens
  Native (IDH1 R132C)
VSGWVKPIIIGCHAYGDQYRA

SEQ ID NO: 23491 - protein, 22 aa, Homo sapiens
  Native (IDH1 R132C)
VSGWVKPIIIGCHAYGDQYRAT

SEQ ID NO: 23492 - protein, 23 aa, Homo sapiens
  Native (IDH1 R132C)
VSGWVKPIIIGCHAYGDQYRATD

SEQ ID NO: 23493 - protein, 24 aa, Homo sapiens
  Native (IDH1 R132C)
VSGWVKPIIIGCHAYGDQYRATDF

SEQ ID NO: 23494 - protein, 25 aa, Homo sapiens
  Native (IDH1 R132C)
VSGWVKPIIIGCHAYGDQYRATDFV

SEQ ID NO: 23495 - protein, 15 aa, Homo sapiens
  Native (IDH1 R132C)
WVKPIIIGCHAYGDQ

SEQ ID NO: 23496 - protein, 16 aa, Homo sapiens
  Native (IDH1 R132C)
WVKPIIIGCHAYGDQY

SEQ ID NO: 23497 - protein, 17 aa, Homo sapiens
  Native (IDH1 R132C)
WVKPIIIGCHAYGDQYR

SEQ ID NO: 23498 - protein, 19 aa, Homo sapiens
  Native (IDH1 R132C)
WVKPIIIGCHAYGDQYRAT

SEQ ID NO: 23499 - protein, 20 aa, Homo sapiens
  Native (IDH1 R132C)
WVKPIIIGCHAYGDQYRATD

SEQ ID NO: 23500 - protein, 21 aa, Homo sapiens
  Native (IDH1 R132C)
WVKPIIIGCHAYGDQYRATDF

SEQ ID NO: 23501 - protein, 22 aa, Homo sapiens
  Native (IDH1 R132C)
WVKPIIIGCHAYGDQYRATDFV

SEQ ID NO: 23502 - protein, 23 aa, Homo sapiens
  Native (IDH1 R132C)
WVKPIIIGCHAYGDQYRATDFVV

SEQ ID NO: 23503 - protein, 24 aa, Homo sapiens
  Native (IDH1 R132C)
WVKPIIIGCHAYGDQYRATDFVVP

SEQ ID NO: 23504 - protein, 25 aa, Homo sapiens
  Native (IDH1 R132C)
WVKPIIIGCHAYGDQYRATDFVVPG

SEQ ID NO: 23505 - protein, 24 aa, Homo sapiens
  Native (IDH1 R132H)
AIICKNIPRLVSGWVKPIIIGHHA

SEQ ID NO: 23506 - protein, 25 aa, Homo sapiens
  Native (IDH1 R132H)
AIICKNIPRLVSGWVKPIIIGHHAY

SEQ ID NO: 23507 - protein, 21 aa, Homo sapiens
  Native (IDH1 R132H)
CKNIPRLVSGWVKPIIIGHHA

SEQ ID NO: 23508 - protein, 22 aa, Homo sapiens
  Native (IDH1 R132H)
CKNIPRLVSGWVKPIIIGHHAY

SEQ ID NO: 23509 - protein, 23 aa, Homo sapiens
  Native (IDH1 R132H)
CKNIPRLVSGWVKPIIIGHHAYG

SEQ ID NO: 23510 - protein, 24 aa, Homo sapiens
  Native (IDH1 R132H)
CKNIPRLVSGWVKPIIIGHHAYGD

SEQ ID NO: 23511 - protein, 25 aa, Homo sapiens
  Native (IDH1 R132H)
CKNIPRLVSGWVKPIIIGHHAYGDQ

SEQ ID NO: 23512 - protein, 25 aa, Homo sapiens
  Native (IDH1 R132H)
EAIICKNIPRLVSGWVKPIIIGHHA

SEQ ID NO: 23513 - protein, 14 aa, Homo sapiens
  Native (IDH1 R132H)
GWVKPIIIGHHAYG

SEQ ID NO: 23514 - protein, 15 aa, Homo sapiens
  Native (IDH1 R132H)
GWVKPIIIGHHAYGD

SEQ ID NO: 23515 - protein, 16 aa, Homo sapiens
  Native (IDH1 R132H)
GWVKPIIIGHHAYGDQ

SEQ ID NO: 23516 - protein, 17 aa, Homo sapiens
  Native (IDH1 R132H)
GWVKPIIIGHHAYGDQY

SEQ ID NO: 23517 - protein, 19 aa, Homo sapiens
  Native (IDH1 R132H)
GWVKPIIIGHHAYGDQYRA

SEQ ID NO: 23518 - protein, 20 aa, Homo sapiens
  Native (IDH1 R132H)
GWVKPIIIGHHAYGDQYRAT

SEQ ID NO: 23519 - protein, 21 aa, Homo sapiens
  Native (IDH1 R132H)
GWVKPIIIGHHAYGDQYRATD

SEQ ID NO: 23520 - protein, 22 aa, Homo sapiens
  Native (IDH1 R132H)
GWVKPIIIGHHAYGDQYRATDF

SEQ ID NO: 23521 - protein, 23 aa, Homo sapiens
  Native (IDH1 R132H)
GWVKPIIIGHHAYGDQYRATDFV

SEQ ID NO: 23522 - protein, 24 aa, Homo sapiens
  Native (IDH1 R132H)
GWVKPIIIGHHAYGDQYRATDFVV

SEQ ID NO: 23523 - protein, 25 aa, Homo sapiens
  Native (IDH1 R132H)
GWVKPIIIGHHAYGDQYRATDFVVP

SEQ ID NO: 23524 - protein, 22 aa, Homo sapiens
  Native (IDH1 R132H)
ICKNIPRLVSGWVKPIIIGHHA

SEQ ID NO: 23525 - protein, 23 aa, Homo sapiens
  Native (IDH1 R132H)
ICKNIPRLVSGWVKPIIIGHHAY

SEQ ID NO: 23526 - protein, 24 aa, Homo sapiens
  Native (IDH1 R132H)
ICKNIPRLVSGWVKPIIIGHHAYG

SEQ ID NO: 23527 - protein, 25 aa, Homo sapiens
  Native (IDH1 R132H)
ICKNIPRLVSGWVKPIIIGHHAYGD

SEQ ID NO: 23528 - protein, 23 aa, Homo sapiens
  Native (IDH1 R132H)
IICKNIPRLVSGWVKPIIIGHHA

SEQ ID NO: 23529 - protein, 24 aa, Homo sapiens
  Native (IDH1 R132H)
IICKNIPRLVSGWVKPIIIGHHAY

SEQ ID NO: 23530 - protein, 25 aa, Homo sapiens
  Native (IDH1 R132H)
IICKNIPRLVSGWVKPIIIGHHAYG

SEQ ID NO: 23531 - protein, 19 aa, Homo sapiens
  Native (IDH1 R132H)
IPRLVSGWVKPIIIGHHAY

SEQ ID NO: 23532 - protein, 20 aa, Homo sapiens
  Native (IDH1 R132H)
IPRLVSGWVKPIIIGHHAYG

SEQ ID NO: 23533 - protein, 21 aa, Homo sapiens
  Native (IDH1 R132H)
IPRLVSGWVKPIIIGHHAYGD

SEQ ID NO: 23534 - protein, 22 aa, Homo sapiens
  Native (IDH1 R132H)
IPRLVSGWVKPIIIGHHAYGDQ

SEQ ID NO: 23535 - protein, 23 aa, Homo sapiens
  Native (IDH1 R132H)
IPRLVSGWVKPIIIGHHAYGDQY

SEQ ID NO: 23536 - protein, 24 aa, Homo sapiens
  Native (IDH1 R132H)
IPRLVSGWVKPIIIGHHAYGDQYR

SEQ ID NO: 23537 - protein, 25 aa, Homo sapiens
  Native (IDH1 R132H)
IPRLVSGWVKPIIIGHHAYGDQYRA

SEQ ID NO: 23538 - protein, 20 aa, Homo sapiens
  Native (IDH1 R132H)
KNIPRLVSGWVKPIIIGHHA

SEQ ID NO: 23539 - protein, 21 aa, Homo sapiens
  Native (IDH1 R132H)
KNIPRLVSGWVKPIIIGHHAY

SEQ ID NO: 23540 - protein, 22 aa, Homo sapiens
  Native (IDH1 R132H)
KNIPRLVSGWVKPIIIGHHAYG

SEQ ID NO: 23541 - protein, 23 aa, Homo sapiens
  Native (IDH1 R132H)
KNIPRLVSGWVKPIIIGHHAYGD

SEQ ID NO: 23542 - protein, 24 aa, Homo sapiens
  Native (IDH1 R132H)
KNIPRLVSGWVKPIIIGHHAYGDQ

SEQ ID NO: 23543 - protein, 25 aa, Homo sapiens
  Native (IDH1 R132H)
KNIPRLVSGWVKPIIIGHHAYGDQY

SEQ ID NO: 23544 - protein, 14 aa, Homo sapiens
  Native (IDH1 R132H)
KPIIIGHHAYGDQY

SEQ ID NO: 23545 - protein, 15 aa, Homo sapiens
  Native (IDH1 R132H)
KPIIIGHHAYGDQYR

SEQ ID NO: 23546 - protein, 16 aa, Homo sapiens
  Native (IDH1 R132H)
KPIIIGHHAYGDQYRA

SEQ ID NO: 23547 - protein, 17 aa, Homo sapiens
  Native (IDH1 R132H)
KPIIIGHHAYGDQYRAT

SEQ ID NO: 23548 - protein, 20 aa, Homo sapiens
  Native (IDH1 R132H)
KPIIIGHHAYGDQYRATDFV

SEQ ID NO: 23549 - protein, 23 aa, Homo sapiens
  Native (IDH1 R132H)
KPIIIGHHAYGDQYRATDFVVPG

SEQ ID NO: 23550 - protein, 24 aa, Homo sapiens
  Native (IDH1 R132H)
KPIIIGHHAYGDQYRATDFVVPGP

SEQ ID NO: 23551 - protein, 25 aa, Homo sapiens
  Native (IDH1 R132H)
KPIIIGHHAYGDQYRATDFVVPGPG

SEQ ID NO: 23552 - protein, 14 aa, Homo sapiens
  Native (IDH1 R132H)
LVSGWVKPIIIGHH

SEQ ID NO: 23553 - protein, 15 aa, Homo sapiens
  Native (IDH1 R132H)
LVSGWVKPIIIGHHA

SEQ ID NO: 23554 - protein, 16 aa, Homo sapiens
  Native (IDH1 R132H)
LVSGWVKPIIIGHHAY

SEQ ID NO: 23555 - protein, 17 aa, Homo sapiens
  Native (IDH1 R132H)
LVSGWVKPIIIGHHAYG

SEQ ID NO: 23556 - protein, 19 aa, Homo sapiens
  Native (IDH1 R132H)
LVSGWVKPIIIGHHAYGDQ

SEQ ID NO: 23557 - protein, 20 aa, Homo sapiens
  Native (IDH1 R132H)
LVSGWVKPIIIGHHAYGDQY

SEQ ID NO: 23558 - protein, 21 aa, Homo sapiens
  Native (IDH1 R132H)
LVSGWVKPIIIGHHAYGDQYR

SEQ ID NO: 23559 - protein, 22 aa, Homo sapiens
  Native (IDH1 R132H)
LVSGWVKPIIIGHHAYGDQYRA

SEQ ID NO: 23560 - protein, 23 aa, Homo sapiens
  Native (IDH1 R132H)
LVSGWVKPIIIGHHAYGDQYRAT

SEQ ID NO: 23561 - protein, 24 aa, Homo sapiens
  Native (IDH1 R132H)
LVSGWVKPIIIGHHAYGDQYRATD

SEQ ID NO: 23562 - protein, 25 aa, Homo sapiens
  Native (IDH1 R132H)
LVSGWVKPIIIGHHAYGDQYRATDF

SEQ ID NO: 23563 - protein, 19 aa, Homo sapiens
  Native (IDH1 R132H)
NIPRLVSGWVKPIIIGHHA

SEQ ID NO: 23564 - protein, 20 aa, Homo sapiens
  Native (IDH1 R132H)
NIPRLVSGWVKPIIIGHHAY

SEQ ID NO: 23565 - protein, 21 aa, Homo sapiens
  Native (IDH1 R132H)
NIPRLVSGWVKPIIIGHHAYG

SEQ ID NO: 23566 - protein, 22 aa, Homo sapiens
  Native (IDH1 R132H)
NIPRLVSGWVKPIIIGHHAYGD

SEQ ID NO: 23567 - protein, 23 aa, Homo sapiens
  Native (IDH1 R132H)
NIPRLVSGWVKPIIIGHHAYGDQ

SEQ ID NO: 23568 - protein, 24 aa, Homo sapiens
  Native (IDH1 R132H)
NIPRLVSGWVKPIIIGHHAYGDQY

SEQ ID NO: 23569 - protein, 25 aa, Homo sapiens
  Native (IDH1 R132H)
NIPRLVSGWVKPIIIGHHAYGDQYR

SEQ ID NO: 23570 - protein, 15 aa, Homo sapiens
  Native (IDH1 R132H)
PIIIGHHAYGDQYRA

SEQ ID NO: 23571 - protein, 17 aa, Homo sapiens
  Native (IDH1 R132H)
PRLVSGWVKPIIIGHHA

SEQ ID NO: 23572 - protein, 18 aa, Homo sapiens
  Native (IDH1 R132H)
PRLVSGWVKPIIIGHHAY

SEQ ID NO: 23573 - protein, 19 aa, Homo sapiens
  Native (IDH1 R132H)
PRLVSGWVKPIIIGHHAYG

SEQ ID NO: 23574 - protein, 20 aa, Homo sapiens
  Native (IDH1 R132H)
PRLVSGWVKPIIIGHHAYGD

SEQ ID NO: 23575 - protein, 21 aa, Homo sapiens
  Native (IDH1 R132H)
PRLVSGWVKPIIIGHHAYGDQ

SEQ ID NO: 23576 - protein, 22 aa, Homo sapiens
  Native (IDH1 R132H)
PRLVSGWVKPIIIGHHAYGDQY

SEQ ID NO: 23577 - protein, 23 aa, Homo sapiens
  Native (IDH1 R132H)
PRLVSGWVKPIIIGHHAYGDQYR

SEQ ID NO: 23578 - protein, 24 aa, Homo sapiens
  Native (IDH1 R132H)
PRLVSGWVKPIIIGHHAYGDQYRA

SEQ ID NO: 23579 - protein, 25 aa, Homo sapiens
  Native (IDH1 R132H)
PRLVSGWVKPIIIGHHAYGDQYRAT

SEQ ID NO: 23580 - protein, 16 aa, Homo sapiens
  Native (IDH1 R132H)
RLVSGWVKPIIIGHHA

SEQ ID NO: 23581 - protein, 17 aa, Homo sapiens
  Native (IDH1 R132H)
RLVSGWVKPIIIGHHAY

SEQ ID NO: 23582 - protein, 18 aa, Homo sapiens
  Native (IDH1 R132H)
RLVSGWVKPIIIGHHAYG

SEQ ID NO: 23583 - protein, 19 aa, Homo sapiens
  Native (IDH1 R132H)
RLVSGWVKPIIIGHHAYGD

SEQ ID NO: 23584 - protein, 20 aa, Homo sapiens
  Native (IDH1 R132H)
RLVSGWVKPIIIGHHAYGDQ

SEQ ID NO: 23585 - protein, 21 aa, Homo sapiens
  Native (IDH1 R132H)
RLVSGWVKPIIIGHHAYGDQY

SEQ ID NO: 23586 - protein, 22 aa, Homo sapiens
  Native (IDH1 R132H)
RLVSGWVKPIIIGHHAYGDQYR

SEQ ID NO: 23587 - protein, 23 aa, Homo sapiens
  Native (IDH1 R132H)
RLVSGWVKPIIIGHHAYGDQYRA

SEQ ID NO: 23588 - protein, 24 aa, Homo sapiens
  Native (IDH1 R132H)
RLVSGWVKPIIIGHHAYGDQYRAT

SEQ ID NO: 23589 - protein, 25 aa, Homo sapiens
  Native (IDH1 R132H)
RLVSGWVKPIIIGHHAYGDQYRATD

SEQ ID NO: 23590 - protein, 15 aa, Homo sapiens
  Native (IDH1 R132H)
SGWVKPIIIGHHAYG

SEQ ID NO: 23591 - protein, 16 aa, Homo sapiens
  Native (IDH1 R132H)
SGWVKPIIIGHHAYGD

SEQ ID NO: 23592 - protein, 17 aa, Homo sapiens
  Native (IDH1 R132H)
SGWVKPIIIGHHAYGDQ

SEQ ID NO: 23593 - protein, 19 aa, Homo sapiens
  Native (IDH1 R132H)
SGWVKPIIIGHHAYGDQYR

SEQ ID NO: 23594 - protein, 20 aa, Homo sapiens
  Native (IDH1 R132H)
SGWVKPIIIGHHAYGDQYRA

SEQ ID NO: 23595 - protein, 21 aa, Homo sapiens
  Native (IDH1 R132H)
SGWVKPIIIGHHAYGDQYRAT

SEQ ID NO: 23596 - protein, 22 aa, Homo sapiens
  Native (IDH1 R132H)
SGWVKPIIIGHHAYGDQYRATD

SEQ ID NO: 23597 - protein, 23 aa, Homo sapiens
  Native (IDH1 R132H)
SGWVKPIIIGHHAYGDQYRATDF

SEQ ID NO: 23598 - protein, 24 aa, Homo sapiens
  Native (IDH1 R132H)
SGWVKPIIIGHHAYGDQYRATDFV

SEQ ID NO: 23599 - protein, 25 aa, Homo sapiens
  Native (IDH1 R132H)
SGWVKPIIIGHHAYGDQYRATDFVV

SEQ ID NO: 23600 - protein, 14 aa, Homo sapiens
  Native (IDH1 R132H)
VKPIIIGHHAYGDQ

SEQ ID NO: 23601 - protein, 15 aa, Homo sapiens
  Native (IDH1 R132H)
VKPIIIGHHAYGDQY

SEQ ID NO: 23602 - protein, 16 aa, Homo sapiens
  Native (IDH1 R132H)
VKPIIIGHHAYGDQYR

SEQ ID NO: 23603 - protein, 17 aa, Homo sapiens
  Native (IDH1 R132H)
VKPIIIGHHAYGDQYRA

SEQ ID NO: 23604 - protein, 19 aa, Homo sapiens
  Native (IDH1 R132H)
VKPIIIGHHAYGDQYRATD

SEQ ID NO: 23605 - protein, 20 aa, Homo sapiens
  Native (IDH1 R132H)
VKPIIIGHHAYGDQYRATDF

SEQ ID NO: 23606 - protein, 21 aa, Homo sapiens
  Native (IDH1 R132H)
VKPIIIGHHAYGDQYRATDFV

SEQ ID NO: 23607 - protein, 22 aa, Homo sapiens
  Native (IDH1 R132H)
VKPIIIGHHAYGDQYRATDFVV

SEQ ID NO: 23608 - protein, 23 aa, Homo sapiens
  Native (IDH1 R132H)
VKPIIIGHHAYGDQYRATDFVVP

SEQ ID NO: 23609 - protein, 24 aa, Homo sapiens
  Native (IDH1 R132H)
VKPIIIGHHAYGDQYRATDFVVPG

SEQ ID NO: 23610 - protein, 25 aa, Homo sapiens
  Native (IDH1 R132H)
VKPIIIGHHAYGDQYRATDFVVPGP

SEQ ID NO: 23611 - protein, 15 aa, Homo sapiens
  Native (IDH1 R132H)
VSGWVKPIIIGHHAY

SEQ ID NO: 23612 - protein, 16 aa, Homo sapiens
  Native (IDH1 R132H)
VSGWVKPIIIGHHAYG

SEQ ID NO: 23613 - protein, 17 aa, Homo sapiens
  Native (IDH1 R132H)
VSGWVKPIIIGHHAYGD

SEQ ID NO: 23614 - protein, 19 aa, Homo sapiens
  Native (IDH1 R132H)
VSGWVKPIIIGHHAYGDQY

SEQ ID NO: 23615 - protein, 20 aa, Homo sapiens
  Native (IDH1 R132H)
VSGWVKPIIIGHHAYGDQYR

SEQ ID NO: 23616 - protein, 21 aa, Homo sapiens
  Native (IDH1 R132H)
VSGWVKPIIIGHHAYGDQYRA

SEQ ID NO: 23617 - protein, 22 aa, Homo sapiens
  Native (IDH1 R132H)
VSGWVKPIIIGHHAYGDQYRAT

SEQ ID NO: 23618 - protein, 23 aa, Homo sapiens
  Native (IDH1 R132H)
VSGWVKPIIIGHHAYGDQYRATD

SEQ ID NO: 23619 - protein, 24 aa, Homo sapiens
  Native (IDH1 R132H)
VSGWVKPIIIGHHAYGDQYRATDF

SEQ ID NO: 23620 - protein, 25 aa, Homo sapiens
  Native (IDH1 R132H)
VSGWVKPIIIGHHAYGDQYRATDFV

SEQ ID NO: 23621 - protein, 14 aa, Homo sapiens
  Native (IDH1 R132H)
WVKPIIIGHHAYGD

SEQ ID NO: 23622 - protein, 15 aa, Homo sapiens
  Native (IDH1 R132H)
WVKPIIIGHHAYGDQ

SEQ ID NO: 23623 - protein, 16 aa, Homo sapiens
  Native (IDH1 R132H)
WVKPIIIGHHAYGDQY

SEQ ID NO: 23624 - protein, 17 aa, Homo sapiens
  Native (IDH1 R132H)
WVKPIIIGHHAYGDQYR

SEQ ID NO: 23625 - protein, 19 aa, Homo sapiens
  Native (IDH1 R132H)
WVKPIIIGHHAYGDQYRAT

SEQ ID NO: 23626 - protein, 20 aa, Homo sapiens
  Native (IDH1 R132H)
WVKPIIIGHHAYGDQYRATD

SEQ ID NO: 23627 - protein, 21 aa, Homo sapiens
  Native (IDH1 R132H)
WVKPIIIGHHAYGDQYRATDF

SEQ ID NO: 23628 - protein, 22 aa, Homo sapiens
  Native (IDH1 R132H)
WVKPIIIGHHAYGDQYRATDFV

SEQ ID NO: 23629 - protein, 23 aa, Homo sapiens
  Native (IDH1 R132H)
WVKPIIIGHHAYGDQYRATDFVV

SEQ ID NO: 23630 - protein, 24 aa, Homo sapiens
  Native (IDH1 R132H)
WVKPIIIGHHAYGDQYRATDFVVP

SEQ ID NO: 23631 - protein, 25 aa, Homo sapiens
  Native (IDH1 R132H)
WVKPIIIGHHAYGDQYRATDFVVPG

SEQ ID NO: 23632 - protein, 13 aa, Homo sapiens
  Native (KRAS G12A)
EYKLVVVGAAGVG

SEQ ID NO: 23633 - protein, 14 aa, Homo sapiens
  Native (KRAS G12A)
EYKLVVVGAAGVGK

SEQ ID NO: 23634 - protein, 15 aa, Homo sapiens
  Native (KRAS G12A)
EYKLVVVGAAGVGKS

SEQ ID NO: 23635 - protein, 16 aa, Homo sapiens
  Native (KRAS G12A)
EYKLVVVGAAGVGKSA

SEQ ID NO: 23636 - protein, 17 aa, Homo sapiens
  Native (KRAS G12A)
EYKLVVVGAAGVGKSAL

SEQ ID NO: 23637 - protein, 18 aa, Homo sapiens
  Native (KRAS G12A)
EYKLVVVGAAGVGKSALT

SEQ ID NO: 23638 - protein, 19 aa, Homo sapiens
  Native (KRAS G12A)
EYKLVVVGAAGVGKSALTI

SEQ ID NO: 23639 - protein, 20 aa, Homo sapiens
  Native (KRAS G12A)
EYKLVVVGAAGVGKSALTIQ

SEQ ID NO: 23640 - protein, 21 aa, Homo sapiens
  Native (KRAS G12A)
EYKLVVVGAAGVGKSALTIQL

SEQ ID NO: 23641 - protein, 22 aa, Homo sapiens
  Native (KRAS G12A)
EYKLVVVGAAGVGKSALTIQLI

SEQ ID NO: 23642 - protein, 23 aa, Homo sapiens
  Native (KRAS G12A)
EYKLVVVGAAGVGKSALTIQLIQ

SEQ ID NO: 23643 - protein, 24 aa, Homo sapiens
  Native (KRAS G12A)
EYKLVVVGAAGVGKSALTIQLIQN

SEQ ID NO: 23644 - protein, 25 aa, Homo sapiens
  Native (KRAS G12A)
EYKLVVVGAAGVGKSALTIQLIQNH

SEQ ID NO: 23645 - protein, 13 aa, Homo sapiens
  Native (KRAS G12A)
KLVVVGAAGVGKS

SEQ ID NO: 23646 - protein, 14 aa, Homo sapiens
  Native (KRAS G12A)
KLVVVGAAGVGKSA

SEQ ID NO: 23647 - protein, 15 aa, Homo sapiens
  Native (KRAS G12A)
KLVVVGAAGVGKSAL

SEQ ID NO: 23648 - protein, 16 aa, Homo sapiens
  Native (KRAS G12A)
KLVVVGAAGVGKSALT

SEQ ID NO: 23649 - protein, 17 aa, Homo sapiens
  Native (KRAS G12A)
KLVVVGAAGVGKSALTI

SEQ ID NO: 23650 - protein, 19 aa, Homo sapiens
  Native (KRAS G12A)
KLVVVGAAGVGKSALTIQL

SEQ ID NO: 23651 - protein, 20 aa, Homo sapiens
  Native (KRAS G12A)
KLVVVGAAGVGKSALTIQLI

SEQ ID NO: 23652 - protein, 21 aa, Homo sapiens
  Native (KRAS G12A)
KLVVVGAAGVGKSALTIQLIQ

SEQ ID NO: 23653 - protein, 22 aa, Homo sapiens
  Native (KRAS G12A)
KLVVVGAAGVGKSALTIQLIQN

SEQ ID NO: 23654 - protein, 23 aa, Homo sapiens
  Native (KRAS G12A)
KLVVVGAAGVGKSALTIQLIQNH

SEQ ID NO: 23655 - protein, 24 aa, Homo sapiens
  Native (KRAS G12A)
KLVVVGAAGVGKSALTIQLIQNHF

SEQ ID NO: 23656 - protein, 25 aa, Homo sapiens
  Native (KRAS G12A)
KLVVVGAAGVGKSALTIQLIQNHFV

SEQ ID NO: 23657 - protein, 14 aa, Homo sapiens
  Native (KRAS G12A)
LVVVGAAGVGKSAL

SEQ ID NO: 23658 - protein, 15 aa, Homo sapiens
  Native (KRAS G12A)
LVVVGAAGVGKSALT

SEQ ID NO: 23659 - protein, 16 aa, Homo sapiens
  Native (KRAS G12A)
LVVVGAAGVGKSALTI

SEQ ID NO: 23660 - protein, 17 aa, Homo sapiens
  Native (KRAS G12A)
LVVVGAAGVGKSALTIQ

SEQ ID NO: 23661 - protein, 14 aa, Homo sapiens
  Native (KRAS G12A)
MTEYKLVVVGAAGV

SEQ ID NO: 23662 - protein, 15 aa, Homo sapiens
  Native (KRAS G12A)
MTEYKLVVVGAAGVG

SEQ ID NO: 23663 - protein, 16 aa, Homo sapiens
  Native (KRAS G12A)
MTEYKLVVVGAAGVGK

SEQ ID NO: 23664 - protein, 17 aa, Homo sapiens
  Native (KRAS G12A)
MTEYKLVVVGAAGVGKS

SEQ ID NO: 23665 - protein, 18 aa, Homo sapiens
  Native (KRAS G12A)
MTEYKLVVVGAAGVGKSA

SEQ ID NO: 23666 - protein, 19 aa, Homo sapiens
  Native (KRAS G12A)
MTEYKLVVVGAAGVGKSAL

SEQ ID NO: 23667 - protein, 20 aa, Homo sapiens
  Native (KRAS G12A)
MTEYKLVVVGAAGVGKSALT

SEQ ID NO: 23668 - protein, 21 aa, Homo sapiens
  Native (KRAS G12A)
MTEYKLVVVGAAGVGKSALTI

SEQ ID NO: 23669 - protein, 22 aa, Homo sapiens
  Native (KRAS G12A)
MTEYKLVVVGAAGVGKSALTIQ

SEQ ID NO: 23670 - protein, 23 aa, Homo sapiens
  Native (KRAS G12A)
MTEYKLVVVGAAGVGKSALTIQL

SEQ ID NO: 23671 - protein, 24 aa, Homo sapiens
  Native (KRAS G12A)
MTEYKLVVVGAAGVGKSALTIQLI

SEQ ID NO: 23672 - protein, 25 aa, Homo sapiens
  Native (KRAS G12A)
MTEYKLVVVGAAGVGKSALTIQLIQ

SEQ ID NO: 23673 - protein, 13 aa, Homo sapiens
  Native (KRAS G12A)
TEYKLVVVGAAGV

SEQ ID NO: 23674 - protein, 14 aa, Homo sapiens
  Native (KRAS G12A)
TEYKLVVVGAAGVG

SEQ ID NO: 23675 - protein, 15 aa, Homo sapiens
  Native (KRAS G12A)
TEYKLVVVGAAGVGK

SEQ ID NO: 23676 - protein, 16 aa, Homo sapiens
  Native (KRAS G12A)
TEYKLVVVGAAGVGKS

SEQ ID NO: 23677 - protein, 17 aa, Homo sapiens
  Native (KRAS G12A)
TEYKLVVVGAAGVGKSA

SEQ ID NO: 23678 - protein, 18 aa, Homo sapiens
  Native (KRAS G12A)
TEYKLVVVGAAGVGKSAL

SEQ ID NO: 23679 - protein, 19 aa, Homo sapiens
  Native (KRAS G12A)
TEYKLVVVGAAGVGKSALT

SEQ ID NO: 23680 - protein, 20 aa, Homo sapiens
  Native (KRAS G12A)
TEYKLVVVGAAGVGKSALTI

SEQ ID NO: 23681 - protein, 21 aa, Homo sapiens
  Native (KRAS G12A)
TEYKLVVVGAAGVGKSALTIQ

SEQ ID NO: 23682 - protein, 22 aa, Homo sapiens
  Native (KRAS G12A)
TEYKLVVVGAAGVGKSALTIQL

SEQ ID NO: 23683 - protein, 23 aa, Homo sapiens
  Native (KRAS G12A)
TEYKLVVVGAAGVGKSALTIQLI

SEQ ID NO: 23684 - protein, 24 aa, Homo sapiens
  Native (KRAS G12A)
TEYKLVVVGAAGVGKSALTIQLIQ

SEQ ID NO: 23685 - protein, 25 aa, Homo sapiens
  Native (KRAS G12A)
TEYKLVVVGAAGVGKSALTIQLIQN

SEQ ID NO: 23686 - protein, 15 aa, Homo sapiens
  Native (KRAS G12A)
VVVGAAGVGKSALTI

SEQ ID NO: 23687 - protein, 13 aa, Homo sapiens
  Native (KRAS G12A)
YKLVVVGAAGVGK

SEQ ID NO: 23688 - protein, 14 aa, Homo sapiens
  Native (KRAS G12A)
YKLVVVGAAGVGKS

SEQ ID NO: 23689 - protein, 15 aa, Homo sapiens
  Native (KRAS G12A)
YKLVVVGAAGVGKSA

SEQ ID NO: 23690 - protein, 16 aa, Homo sapiens
  Native (KRAS G12A)
YKLVVVGAAGVGKSAL

SEQ ID NO: 23691 - protein, 17 aa, Homo sapiens
  Native (KRAS G12A)
YKLVVVGAAGVGKSALT

SEQ ID NO: 23692 - protein, 18 aa, Homo sapiens
  Native (KRAS G12A)
YKLVVVGAAGVGKSALTI

SEQ ID NO: 23693 - protein, 19 aa, Homo sapiens
  Native (KRAS G12A)
YKLVVVGAAGVGKSALTIQ

SEQ ID NO: 23694 - protein, 20 aa, Homo sapiens
  Native (KRAS G12A)
YKLVVVGAAGVGKSALTIQL

SEQ ID NO: 23695 - protein, 21 aa, Homo sapiens
  Native (KRAS G12A)
YKLVVVGAAGVGKSALTIQLI

SEQ ID NO: 23696 - protein, 22 aa, Homo sapiens
  Native (KRAS G12A)
YKLVVVGAAGVGKSALTIQLIQ

SEQ ID NO: 23697 - protein, 23 aa, Homo sapiens
  Native (KRAS G12A)
YKLVVVGAAGVGKSALTIQLIQN

SEQ ID NO: 23698 - protein, 24 aa, Homo sapiens
  Native (KRAS G12A)
YKLVVVGAAGVGKSALTIQLIQNH

SEQ ID NO: 23699 - protein, 25 aa, Homo sapiens
  Native (KRAS G12A)
YKLVVVGAAGVGKSALTIQLIQNHF

SEQ ID NO: 23700 - protein, 13 aa, Homo sapiens
  Native (KRAS G12C)
EYKLVVVGACGVG

SEQ ID NO: 23701 - protein, 14 aa, Homo sapiens
  Native (KRAS G12C)
EYKLVVVGACGVGK

SEQ ID NO: 23702 - protein, 15 aa, Homo sapiens
  Native (KRAS G12C)
EYKLVVVGACGVGKS

SEQ ID NO: 23703 - protein, 16 aa, Homo sapiens
  Native (KRAS G12C)
EYKLVVVGACGVGKSA

SEQ ID NO: 23704 - protein, 17 aa, Homo sapiens
  Native (KRAS G12C)
EYKLVVVGACGVGKSAL

SEQ ID NO: 23705 - protein, 19 aa, Homo sapiens
  Native (KRAS G12C)
EYKLVVVGACGVGKSALTI

SEQ ID NO: 23706 - protein, 20 aa, Homo sapiens
  Native (KRAS G12C)
EYKLVVVGACGVGKSALTIQ

SEQ ID NO: 23707 - protein, 21 aa, Homo sapiens
  Native (KRAS G12C)
EYKLVVVGACGVGKSALTIQL

SEQ ID NO: 23708 - protein, 22 aa, Homo sapiens
  Native (KRAS G12C)
EYKLVVVGACGVGKSALTIQLI

SEQ ID NO: 23709 - protein, 23 aa, Homo sapiens
  Native (KRAS G12C)
EYKLVVVGACGVGKSALTIQLIQ

SEQ ID NO: 23710 - protein, 24 aa, Homo sapiens
  Native (KRAS G12C)
EYKLVVVGACGVGKSALTIQLIQN

SEQ ID NO: 23711 - protein, 25 aa, Homo sapiens
  Native (KRAS G12C)
EYKLVVVGACGVGKSALTIQLIQNH

SEQ ID NO: 23712 - protein, 14 aa, Homo sapiens
  Native (KRAS G12C)
KLVVVGACGVGKSA

SEQ ID NO: 23713 - protein, 15 aa, Homo sapiens
  Native (KRAS G12C)
KLVVVGACGVGKSAL

SEQ ID NO: 23714 - protein, 16 aa, Homo sapiens
  Native (KRAS G12C)
KLVVVGACGVGKSALT

SEQ ID NO: 23715 - protein, 17 aa, Homo sapiens
  Native (KRAS G12C)
KLVVVGACGVGKSALTI

SEQ ID NO: 23716 - protein, 19 aa, Homo sapiens
  Native (KRAS G12C)
KLVVVGACGVGKSALTIQL

SEQ ID NO: 23717 - protein, 20 aa, Homo sapiens
  Native (KRAS G12C)
KLVVVGACGVGKSALTIQLI

SEQ ID NO: 23718 - protein, 15 aa, Homo sapiens
  Native (KRAS G12C)
MTEYKLVVVGACGVG

SEQ ID NO: 23719 - protein, 16 aa, Homo sapiens
  Native (KRAS G12C)
MTEYKLVVVGACGVGK

SEQ ID NO: 23720 - protein, 17 aa, Homo sapiens
  Native (KRAS G12C)
MTEYKLVVVGACGVGKS

SEQ ID NO: 23721 - protein, 18 aa, Homo sapiens
  Native (KRAS G12C)
MTEYKLVVVGACGVGKSA

SEQ ID NO: 23722 - protein, 19 aa, Homo sapiens
  Native (KRAS G12C)
MTEYKLVVVGACGVGKSAL

SEQ ID NO: 23723 - protein, 20 aa, Homo sapiens
  Native (KRAS G12C)
MTEYKLVVVGACGVGKSALT

SEQ ID NO: 23724 - protein, 21 aa, Homo sapiens
  Native (KRAS G12C)
MTEYKLVVVGACGVGKSALTI

SEQ ID NO: 23725 - protein, 22 aa, Homo sapiens
  Native (KRAS G12C)
MTEYKLVVVGACGVGKSALTIQ

SEQ ID NO: 23726 - protein, 23 aa, Homo sapiens
  Native (KRAS G12C)
MTEYKLVVVGACGVGKSALTIQL

SEQ ID NO: 23727 - protein, 24 aa, Homo sapiens
  Native (KRAS G12C)
MTEYKLVVVGACGVGKSALTIQLI

SEQ ID NO: 23728 - protein, 25 aa, Homo sapiens
  Native (KRAS G12C)
MTEYKLVVVGACGVGKSALTIQLIQ

SEQ ID NO: 23729 - protein, 15 aa, Homo sapiens
  Native (KRAS G12C)
TEYKLVVVGACGVGK

SEQ ID NO: 23730 - protein, 16 aa, Homo sapiens
  Native (KRAS G12C)
TEYKLVVVGACGVGKS

SEQ ID NO: 23731 - protein, 17 aa, Homo sapiens
  Native (KRAS G12C)
TEYKLVVVGACGVGKSA

SEQ ID NO: 23732 - protein, 18 aa, Homo sapiens
  Native (KRAS G12C)
TEYKLVVVGACGVGKSAL

SEQ ID NO: 23733 - protein, 19 aa, Homo sapiens
  Native (KRAS G12C)
TEYKLVVVGACGVGKSALT

SEQ ID NO: 23734 - protein, 20 aa, Homo sapiens
  Native (KRAS G12C)
TEYKLVVVGACGVGKSALTI

SEQ ID NO: 23735 - protein, 21 aa, Homo sapiens
  Native (KRAS G12C)
TEYKLVVVGACGVGKSALTIQ

SEQ ID NO: 23736 - protein, 22 aa, Homo sapiens
  Native (KRAS G12C)
TEYKLVVVGACGVGKSALTIQL

SEQ ID NO: 23737 - protein, 23 aa, Homo sapiens
  Native (KRAS G12C)
TEYKLVVVGACGVGKSALTIQLI

SEQ ID NO: 23738 - protein, 24 aa, Homo sapiens
  Native (KRAS G12C)
TEYKLVVVGACGVGKSALTIQLIQ

SEQ ID NO: 23739 - protein, 25 aa, Homo sapiens
  Native (KRAS G12C)
TEYKLVVVGACGVGKSALTIQLIQN

SEQ ID NO: 23740 - protein, 13 aa, Homo sapiens
  Native (KRAS G12C)
YKLVVVGACGVGK

SEQ ID NO: 23741 - protein, 14 aa, Homo sapiens
  Native (KRAS G12C)
YKLVVVGACGVGKS

SEQ ID NO: 23742 - protein, 15 aa, Homo sapiens
  Native (KRAS G12C)
YKLVVVGACGVGKSA

SEQ ID NO: 23743 - protein, 16 aa, Homo sapiens
  Native (KRAS G12C)
YKLVVVGACGVGKSAL

SEQ ID NO: 23744 - protein, 17 aa, Homo sapiens
  Native (KRAS G12C)
YKLVVVGACGVGKSALT

SEQ ID NO: 23745 - protein, 19 aa, Homo sapiens
  Native (KRAS G12C)
YKLVVVGACGVGKSALTIQ

SEQ ID NO: 23746 - protein, 20 aa, Homo sapiens
  Native (KRAS G12C)
YKLVVVGACGVGKSALTIQL

SEQ ID NO: 23747 - protein, 21 aa, Homo sapiens
  Native (KRAS G12C)
YKLVVVGACGVGKSALTIQLI

SEQ ID NO: 23748 - protein, 22 aa, Homo sapiens
  Native (KRAS G12C)
YKLVVVGACGVGKSALTIQLIQ

SEQ ID NO: 23749 - protein, 23 aa, Homo sapiens
  Native (KRAS G12C)
YKLVVVGACGVGKSALTIQLIQN

SEQ ID NO: 23750 - protein, 13 aa, Homo sapiens
  Native (KRAS G12D)
EYKLVVVGADGVG

SEQ ID NO: 23751 - protein, 14 aa, Homo sapiens
  Native (KRAS G12D)
EYKLVVVGADGVGK

SEQ ID NO: 23752 - protein, 15 aa, Homo sapiens
  Native (KRAS G12D)
EYKLVVVGADGVGKS

SEQ ID NO: 23753 - protein, 16 aa, Homo sapiens
  Native (KRAS G12D)
EYKLVVVGADGVGKSA

SEQ ID NO: 23754 - protein, 17 aa, Homo sapiens
  Native (KRAS G12D)
EYKLVVVGADGVGKSAL

SEQ ID NO: 23755 - protein, 18 aa, Homo sapiens
  Native (KRAS G12D)
EYKLVVVGADGVGKSALT

SEQ ID NO: 23756 - protein, 19 aa, Homo sapiens
  Native (KRAS G12D)
EYKLVVVGADGVGKSALTI

SEQ ID NO: 23757 - protein, 20 aa, Homo sapiens
  Native (KRAS G12D)
EYKLVVVGADGVGKSALTIQ

SEQ ID NO: 23758 - protein, 21 aa, Homo sapiens
  Native (KRAS G12D)
EYKLVVVGADGVGKSALTIQL

SEQ ID NO: 23759 - protein, 22 aa, Homo sapiens
  Native (KRAS G12D)
EYKLVVVGADGVGKSALTIQLI

SEQ ID NO: 23760 - protein, 23 aa, Homo sapiens
  Native (KRAS G12D)
EYKLVVVGADGVGKSALTIQLIQ

SEQ ID NO: 23761 - protein, 24 aa, Homo sapiens
  Native (KRAS G12D)
EYKLVVVGADGVGKSALTIQLIQN

SEQ ID NO: 23762 - protein, 25 aa, Homo sapiens
  Native (KRAS G12D)
EYKLVVVGADGVGKSALTIQLIQNH

SEQ ID NO: 23763 - protein, 14 aa, Homo sapiens
  Native (KRAS G12D)
KLVVVGADGVGKSA

SEQ ID NO: 23764 - protein, 15 aa, Homo sapiens
  Native (KRAS G12D)
KLVVVGADGVGKSAL

SEQ ID NO: 23765 - protein, 16 aa, Homo sapiens
  Native (KRAS G12D)
KLVVVGADGVGKSALT

SEQ ID NO: 23766 - protein, 17 aa, Homo sapiens
  Native (KRAS G12D)
KLVVVGADGVGKSALTI

SEQ ID NO: 23767 - protein, 19 aa, Homo sapiens
  Native (KRAS G12D)
KLVVVGADGVGKSALTIQL

SEQ ID NO: 23768 - protein, 20 aa, Homo sapiens
  Native (KRAS G12D)
KLVVVGADGVGKSALTIQLI

SEQ ID NO: 23769 - protein, 21 aa, Homo sapiens
  Native (KRAS G12D)
KLVVVGADGVGKSALTIQLIQ

SEQ ID NO: 23770 - protein, 22 aa, Homo sapiens
  Native (KRAS G12D)
KLVVVGADGVGKSALTIQLIQN

SEQ ID NO: 23771 - protein, 23 aa, Homo sapiens
  Native (KRAS G12D)
KLVVVGADGVGKSALTIQLIQNH

SEQ ID NO: 23772 - protein, 24 aa, Homo sapiens
  Native (KRAS G12D)
KLVVVGADGVGKSALTIQLIQNHF

SEQ ID NO: 23773 - protein, 25 aa, Homo sapiens
  Native (KRAS G12D)
KLVVVGADGVGKSALTIQLIQNHFV

SEQ ID NO: 23774 - protein, 15 aa, Homo sapiens
  Native (KRAS G12D)
LVVVGADGVGKSALT

SEQ ID NO: 23775 - protein, 15 aa, Homo sapiens
  Native (KRAS G12D)
MTEYKLVVVGADGVG

SEQ ID NO: 23776 - protein, 16 aa, Homo sapiens
  Native (KRAS G12D)
MTEYKLVVVGADGVGK

SEQ ID NO: 23777 - protein, 17 aa, Homo sapiens
  Native (KRAS G12D)
MTEYKLVVVGADGVGKS

SEQ ID NO: 23778 - protein, 18 aa, Homo sapiens
  Native (KRAS G12D)
MTEYKLVVVGADGVGKSA

SEQ ID NO: 23779 - protein, 19 aa, Homo sapiens
  Native (KRAS G12D)
MTEYKLVVVGADGVGKSAL

SEQ ID NO: 23780 - protein, 20 aa, Homo sapiens
  Native (KRAS G12D)
MTEYKLVVVGADGVGKSALT

SEQ ID NO: 23781 - protein, 21 aa, Homo sapiens
  Native (KRAS G12D)
MTEYKLVVVGADGVGKSALTI

SEQ ID NO: 23782 - protein, 22 aa, Homo sapiens
  Native (KRAS G12D)
MTEYKLVVVGADGVGKSALTIQ

SEQ ID NO: 23783 - protein, 23 aa, Homo sapiens
  Native (KRAS G12D)
MTEYKLVVVGADGVGKSALTIQL

SEQ ID NO: 23784 - protein, 24 aa, Homo sapiens
  Native (KRAS G12D)
MTEYKLVVVGADGVGKSALTIQLI

SEQ ID NO: 23785 - protein, 25 aa, Homo sapiens
  Native (KRAS G12D)
MTEYKLVVVGADGVGKSALTIQLIQ

SEQ ID NO: 23786 - protein, 14 aa, Homo sapiens
  Native (KRAS G12D)
TEYKLVVVGADGVG

SEQ ID NO: 23787 - protein, 15 aa, Homo sapiens
  Native (KRAS G12D)
TEYKLVVVGADGVGK

SEQ ID NO: 23788 - protein, 16 aa, Homo sapiens
  Native (KRAS G12D)
TEYKLVVVGADGVGKS

SEQ ID NO: 23789 - protein, 17 aa, Homo sapiens
  Native (KRAS G12D)
TEYKLVVVGADGVGKSA

SEQ ID NO: 23790 - protein, 18 aa, Homo sapiens
  Native (KRAS G12D)
TEYKLVVVGADGVGKSAL

SEQ ID NO: 23791 - protein, 19 aa, Homo sapiens
  Native (KRAS G12D)
TEYKLVVVGADGVGKSALT

SEQ ID NO: 23792 - protein, 20 aa, Homo sapiens
  Native (KRAS G12D)
TEYKLVVVGADGVGKSALTI

SEQ ID NO: 23793 - protein, 21 aa, Homo sapiens
  Native (KRAS G12D)
TEYKLVVVGADGVGKSALTIQ

SEQ ID NO: 23794 - protein, 22 aa, Homo sapiens
  Native (KRAS G12D)
TEYKLVVVGADGVGKSALTIQL

SEQ ID NO: 23795 - protein, 23 aa, Homo sapiens
  Native (KRAS G12D)
TEYKLVVVGADGVGKSALTIQLI

SEQ ID NO: 23796 - protein, 24 aa, Homo sapiens
  Native (KRAS G12D)
TEYKLVVVGADGVGKSALTIQLIQ

SEQ ID NO: 23797 - protein, 25 aa, Homo sapiens
  Native (KRAS G12D)
TEYKLVVVGADGVGKSALTIQLIQN

SEQ ID NO: 23798 - protein, 14 aa, Homo sapiens
  Native (KRAS G12D)
YKLVVVGADGVGKS

SEQ ID NO: 23799 - protein, 15 aa, Homo sapiens
  Native (KRAS G12D)
YKLVVVGADGVGKSA

SEQ ID NO: 23800 - protein, 16 aa, Homo sapiens
  Native (KRAS G12D)
YKLVVVGADGVGKSAL

SEQ ID NO: 23801 - protein, 17 aa, Homo sapiens
  Native (KRAS G12D)
YKLVVVGADGVGKSALT

SEQ ID NO: 23802 - protein, 18 aa, Homo sapiens
  Native (KRAS G12D)
YKLVVVGADGVGKSALTI

SEQ ID NO: 23803 - protein, 19 aa, Homo sapiens
  Native (KRAS G12D)
YKLVVVGADGVGKSALTIQ

SEQ ID NO: 23804 - protein, 20 aa, Homo sapiens
  Native (KRAS G12D)
YKLVVVGADGVGKSALTIQL

SEQ ID NO: 23805 - protein, 21 aa, Homo sapiens
  Native (KRAS G12D)
YKLVVVGADGVGKSALTIQLI

SEQ ID NO: 23806 - protein, 22 aa, Homo sapiens
  Native (KRAS G12D)
YKLVVVGADGVGKSALTIQLIQ

SEQ ID NO: 23807 - protein, 23 aa, Homo sapiens
  Native (KRAS G12D)
YKLVVVGADGVGKSALTIQLIQN

SEQ ID NO: 23808 - protein, 24 aa, Homo sapiens
  Native (KRAS G12D)
YKLVVVGADGVGKSALTIQLIQNH

SEQ ID NO: 23809 - protein, 25 aa, Homo sapiens
  Native (KRAS G12D)
YKLVVVGADGVGKSALTIQLIQNHF

SEQ ID NO: 23810 - protein, 13 aa, Homo sapiens
  Native (KRAS G12R)
EYKLVVVGARGVG

SEQ ID NO: 23811 - protein, 14 aa, Homo sapiens
  Native (KRAS G12R)
EYKLVVVGARGVGK

SEQ ID NO: 23812 - protein, 15 aa, Homo sapiens
  Native (KRAS G12R)
EYKLVVVGARGVGKS

SEQ ID NO: 23813 - protein, 16 aa, Homo sapiens
  Native (KRAS G12R)
EYKLVVVGARGVGKSA

SEQ ID NO: 23814 - protein, 17 aa, Homo sapiens
  Native (KRAS G12R)
EYKLVVVGARGVGKSAL

SEQ ID NO: 23815 - protein, 18 aa, Homo sapiens
  Native (KRAS G12R)
EYKLVVVGARGVGKSALT

SEQ ID NO: 23816 - protein, 19 aa, Homo sapiens
  Native (KRAS G12R)
EYKLVVVGARGVGKSALTI

SEQ ID NO: 23817 - protein, 20 aa, Homo sapiens
  Native (KRAS G12R)
EYKLVVVGARGVGKSALTIQ

SEQ ID NO: 23818 - protein, 21 aa, Homo sapiens
  Native (KRAS G12R)
EYKLVVVGARGVGKSALTIQL

SEQ ID NO: 23819 - protein, 22 aa, Homo sapiens
  Native (KRAS G12R)
EYKLVVVGARGVGKSALTIQLI

SEQ ID NO: 23820 - protein, 23 aa, Homo sapiens
  Native (KRAS G12R)
EYKLVVVGARGVGKSALTIQLIQ

SEQ ID NO: 23821 - protein, 24 aa, Homo sapiens
  Native (KRAS G12R)
EYKLVVVGARGVGKSALTIQLIQN

SEQ ID NO: 23822 - protein, 25 aa, Homo sapiens
  Native (KRAS G12R)
EYKLVVVGARGVGKSALTIQLIQNH

SEQ ID NO: 23823 - protein, 13 aa, Homo sapiens
  Native (KRAS G12R)
KLVVVGARGVGKS

SEQ ID NO: 23824 - protein, 14 aa, Homo sapiens
  Native (KRAS G12R)
KLVVVGARGVGKSA

SEQ ID NO: 23825 - protein, 15 aa, Homo sapiens
  Native (KRAS G12R)
KLVVVGARGVGKSAL

SEQ ID NO: 23826 - protein, 16 aa, Homo sapiens
  Native (KRAS G12R)
KLVVVGARGVGKSALT

SEQ ID NO: 23827 - protein, 17 aa, Homo sapiens
  Native (KRAS G12R)
KLVVVGARGVGKSALTI

SEQ ID NO: 23828 - protein, 18 aa, Homo sapiens
  Native (KRAS G12R)
KLVVVGARGVGKSALTIQ

SEQ ID NO: 23829 - protein, 19 aa, Homo sapiens
  Native (KRAS G12R)
KLVVVGARGVGKSALTIQL

SEQ ID NO: 23830 - protein, 20 aa, Homo sapiens
  Native (KRAS G12R)
KLVVVGARGVGKSALTIQLI

SEQ ID NO: 23831 - protein, 21 aa, Homo sapiens
  Native (KRAS G12R)
KLVVVGARGVGKSALTIQLIQ

SEQ ID NO: 23832 - protein, 22 aa, Homo sapiens
  Native (KRAS G12R)
KLVVVGARGVGKSALTIQLIQN

SEQ ID NO: 23833 - protein, 23 aa, Homo sapiens
  Native (KRAS G12R)
KLVVVGARGVGKSALTIQLIQNH

SEQ ID NO: 23834 - protein, 24 aa, Homo sapiens
  Native (KRAS G12R)
KLVVVGARGVGKSALTIQLIQNHF

SEQ ID NO: 23835 - protein, 25 aa, Homo sapiens
  Native (KRAS G12R)
KLVVVGARGVGKSALTIQLIQNHFV

SEQ ID NO: 23836 - protein, 14 aa, Homo sapiens
  Native (KRAS G12R)
LVVVGARGVGKSAL

SEQ ID NO: 23837 - protein, 15 aa, Homo sapiens
  Native (KRAS G12R)
LVVVGARGVGKSALT

SEQ ID NO: 23838 - protein, 16 aa, Homo sapiens
  Native (KRAS G12R)
LVVVGARGVGKSALTI

SEQ ID NO: 23839 - protein, 17 aa, Homo sapiens
  Native (KRAS G12R)
LVVVGARGVGKSALTIQ

SEQ ID NO: 23840 - protein, 19 aa, Homo sapiens
  Native (KRAS G12R)
LVVVGARGVGKSALTIQLI

SEQ ID NO: 23841 - protein, 20 aa, Homo sapiens
  Native (KRAS G12R)
LVVVGARGVGKSALTIQLIQ

SEQ ID NO: 23842 - protein, 22 aa, Homo sapiens
  Native (KRAS G12R)
LVVVGARGVGKSALTIQLIQNH

SEQ ID NO: 23843 - protein, 23 aa, Homo sapiens
  Native (KRAS G12R)
LVVVGARGVGKSALTIQLIQNHF

SEQ ID NO: 23844 - protein, 14 aa, Homo sapiens
  Native (KRAS G12R)
MTEYKLVVVGARGV

SEQ ID NO: 23845 - protein, 15 aa, Homo sapiens
  Native (KRAS G12R)
MTEYKLVVVGARGVG

SEQ ID NO: 23846 - protein, 16 aa, Homo sapiens
  Native (KRAS G12R)
MTEYKLVVVGARGVGK

SEQ ID NO: 23847 - protein, 17 aa, Homo sapiens
  Native (KRAS G12R)
MTEYKLVVVGARGVGKS

SEQ ID NO: 23848 - protein, 18 aa, Homo sapiens
  Native (KRAS G12R)
MTEYKLVVVGARGVGKSA

SEQ ID NO: 23849 - protein, 19 aa, Homo sapiens
  Native (KRAS G12R)
MTEYKLVVVGARGVGKSAL

SEQ ID NO: 23850 - protein, 20 aa, Homo sapiens
  Native (KRAS G12R)
MTEYKLVVVGARGVGKSALT

SEQ ID NO: 23851 - protein, 21 aa, Homo sapiens
  Native (KRAS G12R)
MTEYKLVVVGARGVGKSALTI

SEQ ID NO: 23852 - protein, 22 aa, Homo sapiens
  Native (KRAS G12R)
MTEYKLVVVGARGVGKSALTIQ

SEQ ID NO: 23853 - protein, 23 aa, Homo sapiens
  Native (KRAS G12R)
MTEYKLVVVGARGVGKSALTIQL

SEQ ID NO: 23854 - protein, 24 aa, Homo sapiens
  Native (KRAS G12R)
MTEYKLVVVGARGVGKSALTIQLI

SEQ ID NO: 23855 - protein, 25 aa, Homo sapiens
  Native (KRAS G12R)
MTEYKLVVVGARGVGKSALTIQLIQ

SEQ ID NO: 23856 - protein, 13 aa, Homo sapiens
  Native (KRAS G12R)
TEYKLVVVGARGV

SEQ ID NO: 23857 - protein, 14 aa, Homo sapiens
  Native (KRAS G12R)
TEYKLVVVGARGVG

SEQ ID NO: 23858 - protein, 15 aa, Homo sapiens
  Native (KRAS G12R)
TEYKLVVVGARGVGK

SEQ ID NO: 23859 - protein, 16 aa, Homo sapiens
  Native (KRAS G12R)
TEYKLVVVGARGVGKS

SEQ ID NO: 23860 - protein, 17 aa, Homo sapiens
  Native (KRAS G12R)
TEYKLVVVGARGVGKSA

SEQ ID NO: 23861 - protein, 18 aa, Homo sapiens
  Native (KRAS G12R)
TEYKLVVVGARGVGKSAL

SEQ ID NO: 23862 - protein, 19 aa, Homo sapiens
  Native (KRAS G12R)
TEYKLVVVGARGVGKSALT

SEQ ID NO: 23863 - protein, 20 aa, Homo sapiens
  Native (KRAS G12R)
TEYKLVVVGARGVGKSALTI

SEQ ID NO: 23864 - protein, 21 aa, Homo sapiens
  Native (KRAS G12R)
TEYKLVVVGARGVGKSALTIQ

SEQ ID NO: 23865 - protein, 22 aa, Homo sapiens
  Native (KRAS G12R)
TEYKLVVVGARGVGKSALTIQL

SEQ ID NO: 23866 - protein, 23 aa, Homo sapiens
  Native (KRAS G12R)
TEYKLVVVGARGVGKSALTIQLI

SEQ ID NO: 23867 - protein, 24 aa, Homo sapiens
  Native (KRAS G12R)
TEYKLVVVGARGVGKSALTIQLIQ

SEQ ID NO: 23868 - protein, 25 aa, Homo sapiens
  Native (KRAS G12R)
TEYKLVVVGARGVGKSALTIQLIQN

SEQ ID NO: 23869 - protein, 15 aa, Homo sapiens
  Native (KRAS G12R)
VVGARGVGKSALTIQ

SEQ ID NO: 23870 - protein, 16 aa, Homo sapiens
  Native (KRAS G12R)
VVGARGVGKSALTIQL

SEQ ID NO: 23871 - protein, 17 aa, Homo sapiens
  Native (KRAS G12R)
VVGARGVGKSALTIQLI

SEQ ID NO: 23872 - protein, 14 aa, Homo sapiens
  Native (KRAS G12R)
VVVGARGVGKSALT

SEQ ID NO: 23873 - protein, 15 aa, Homo sapiens
  Native (KRAS G12R)
VVVGARGVGKSALTI

SEQ ID NO: 23874 - protein, 16 aa, Homo sapiens
  Native (KRAS G12R)
VVVGARGVGKSALTIQ

SEQ ID NO: 23875 - protein, 17 aa, Homo sapiens
  Native (KRAS G12R)
VVVGARGVGKSALTIQL

SEQ ID NO: 23876 - protein, 22 aa, Homo sapiens
  Native (KRAS G12R)
VVVGARGVGKSALTIQLIQNHF

SEQ ID NO: 23877 - protein, 13 aa, Homo sapiens
  Native (KRAS G12R)
YKLVVVGARGVGK

SEQ ID NO: 23878 - protein, 14 aa, Homo sapiens
  Native (KRAS G12R)
YKLVVVGARGVGKS

SEQ ID NO: 23879 - protein, 15 aa, Homo sapiens
  Native (KRAS G12R)
YKLVVVGARGVGKSA

SEQ ID NO: 23880 - protein, 16 aa, Homo sapiens
  Native (KRAS G12R)
YKLVVVGARGVGKSAL

SEQ ID NO: 23881 - protein, 17 aa, Homo sapiens
  Native (KRAS G12R)
YKLVVVGARGVGKSALT

SEQ ID NO: 23882 - protein, 18 aa, Homo sapiens
  Native (KRAS G12R)
YKLVVVGARGVGKSALTI

SEQ ID NO: 23883 - protein, 19 aa, Homo sapiens
  Native (KRAS G12R)
YKLVVVGARGVGKSALTIQ

SEQ ID NO: 23884 - protein, 20 aa, Homo sapiens
  Native (KRAS G12R)
YKLVVVGARGVGKSALTIQL

SEQ ID NO: 23885 - protein, 21 aa, Homo sapiens
  Native (KRAS G12R)
YKLVVVGARGVGKSALTIQLI

SEQ ID NO: 23886 - protein, 22 aa, Homo sapiens
  Native (KRAS G12R)
YKLVVVGARGVGKSALTIQLIQ

SEQ ID NO: 23887 - protein, 23 aa, Homo sapiens
  Native (KRAS G12R)
YKLVVVGARGVGKSALTIQLIQN

SEQ ID NO: 23888 - protein, 24 aa, Homo sapiens
  Native (KRAS G12R)
YKLVVVGARGVGKSALTIQLIQNH

SEQ ID NO: 23889 - protein, 25 aa, Homo sapiens
  Native (KRAS G12R)
YKLVVVGARGVGKSALTIQLIQNHF

SEQ ID NO: 23890 - protein, 13 aa, Homo sapiens
  Native (KRAS G12S)
EYKLVVVGASGVG

SEQ ID NO: 23891 - protein, 14 aa, Homo sapiens
  Native (KRAS G12S)
EYKLVVVGASGVGK

SEQ ID NO: 23892 - protein, 15 aa, Homo sapiens
  Native (KRAS G12S)
EYKLVVVGASGVGKS

SEQ ID NO: 23893 - protein, 16 aa, Homo sapiens
  Native (KRAS G12S)
EYKLVVVGASGVGKSA

SEQ ID NO: 23894 - protein, 17 aa, Homo sapiens
  Native (KRAS G12S)
EYKLVVVGASGVGKSAL

SEQ ID NO: 23895 - protein, 18 aa, Homo sapiens
  Native (KRAS G12S)
EYKLVVVGASGVGKSALT

SEQ ID NO: 23896 - protein, 19 aa, Homo sapiens
  Native (KRAS G12S)
EYKLVVVGASGVGKSALTI

SEQ ID NO: 23897 - protein, 20 aa, Homo sapiens
  Native (KRAS G12S)
EYKLVVVGASGVGKSALTIQ

SEQ ID NO: 23898 - protein, 21 aa, Homo sapiens
  Native (KRAS G12S)
EYKLVVVGASGVGKSALTIQL

SEQ ID NO: 23899 - protein, 22 aa, Homo sapiens
  Native (KRAS G12S)
EYKLVVVGASGVGKSALTIQLI

SEQ ID NO: 23900 - protein, 23 aa, Homo sapiens
  Native (KRAS G12S)
EYKLVVVGASGVGKSALTIQLIQ

SEQ ID NO: 23901 - protein, 24 aa, Homo sapiens
  Native (KRAS G12S)
EYKLVVVGASGVGKSALTIQLIQN

SEQ ID NO: 23902 - protein, 25 aa, Homo sapiens
  Native (KRAS G12S)
EYKLVVVGASGVGKSALTIQLIQNH

SEQ ID NO: 23903 - protein, 13 aa, Homo sapiens
  Native (KRAS G12S)
KLVVVGASGVGKS

SEQ ID NO: 23904 - protein, 14 aa, Homo sapiens
  Native (KRAS G12S)
KLVVVGASGVGKSA

SEQ ID NO: 23905 - protein, 15 aa, Homo sapiens
  Native (KRAS G12S)
KLVVVGASGVGKSAL

SEQ ID NO: 23906 - protein, 16 aa, Homo sapiens
  Native (KRAS G12S)
KLVVVGASGVGKSALT

SEQ ID NO: 23907 - protein, 17 aa, Homo sapiens
  Native (KRAS G12S)
KLVVVGASGVGKSALTI

SEQ ID NO: 23908 - protein, 19 aa, Homo sapiens
  Native (KRAS G12S)
KLVVVGASGVGKSALTIQL

SEQ ID NO: 23909 - protein, 20 aa, Homo sapiens
  Native (KRAS G12S)
KLVVVGASGVGKSALTIQLI

SEQ ID NO: 23910 - protein, 21 aa, Homo sapiens
  Native (KRAS G12S)
KLVVVGASGVGKSALTIQLIQ

SEQ ID NO: 23911 - protein, 22 aa, Homo sapiens
  Native (KRAS G12S)
KLVVVGASGVGKSALTIQLIQN

SEQ ID NO: 23912 - protein, 23 aa, Homo sapiens
  Native (KRAS G12S)
KLVVVGASGVGKSALTIQLIQNH

SEQ ID NO: 23913 - protein, 24 aa, Homo sapiens
  Native (KRAS G12S)
KLVVVGASGVGKSALTIQLIQNHF

SEQ ID NO: 23914 - protein, 25 aa, Homo sapiens
  Native (KRAS G12S)
KLVVVGASGVGKSALTIQLIQNHFV

SEQ ID NO: 23915 - protein, 14 aa, Homo sapiens
  Native (KRAS G12S)
LVVVGASGVGKSAL

SEQ ID NO: 23916 - protein, 15 aa, Homo sapiens
  Native (KRAS G12S)
LVVVGASGVGKSALT

SEQ ID NO: 23917 - protein, 16 aa, Homo sapiens
  Native (KRAS G12S)
LVVVGASGVGKSALTI

SEQ ID NO: 23918 - protein, 17 aa, Homo sapiens
  Native (KRAS G12S)
LVVVGASGVGKSALTIQ

SEQ ID NO: 23919 - protein, 14 aa, Homo sapiens
  Native (KRAS G12S)
MTEYKLVVVGASGV

SEQ ID NO: 23920 - protein, 15 aa, Homo sapiens
  Native (KRAS G12S)
MTEYKLVVVGASGVG

SEQ ID NO: 23921 - protein, 16 aa, Homo sapiens
  Native (KRAS G12S)
MTEYKLVVVGASGVGK

SEQ ID NO: 23922 - protein, 17 aa, Homo sapiens
  Native (KRAS G12S)
MTEYKLVVVGASGVGKS

SEQ ID NO: 23923 - protein, 18 aa, Homo sapiens
  Native (KRAS G12S)
MTEYKLVVVGASGVGKSA

SEQ ID NO: 23924 - protein, 19 aa, Homo sapiens
  Native (KRAS G12S)
MTEYKLVVVGASGVGKSAL

SEQ ID NO: 23925 - protein, 20 aa, Homo sapiens
  Native (KRAS G12S)
MTEYKLVVVGASGVGKSALT

SEQ ID NO: 23926 - protein, 21 aa, Homo sapiens
  Native (KRAS G12S)
MTEYKLVVVGASGVGKSALTI

SEQ ID NO: 23927 - protein, 22 aa, Homo sapiens
  Native (KRAS G12S)
MTEYKLVVVGASGVGKSALTIQ

SEQ ID NO: 23928 - protein, 23 aa, Homo sapiens
  Native (KRAS G12S)
MTEYKLVVVGASGVGKSALTIQL

SEQ ID NO: 23929 - protein, 24 aa, Homo sapiens
  Native (KRAS G12S)
MTEYKLVVVGASGVGKSALTIQLI

SEQ ID NO: 23930 - protein, 25 aa, Homo sapiens
  Native (KRAS G12S)
MTEYKLVVVGASGVGKSALTIQLIQ

SEQ ID NO: 23931 - protein, 13 aa, Homo sapiens
  Native (KRAS G12S)
TEYKLVVVGASGV

SEQ ID NO: 23932 - protein, 14 aa, Homo sapiens
  Native (KRAS G12S)
TEYKLVVVGASGVG

SEQ ID NO: 23933 - protein, 15 aa, Homo sapiens
  Native (KRAS G12S)
TEYKLVVVGASGVGK

SEQ ID NO: 23934 - protein, 16 aa, Homo sapiens
  Native (KRAS G12S)
TEYKLVVVGASGVGKS

SEQ ID NO: 23935 - protein, 17 aa, Homo sapiens
  Native (KRAS G12S)
TEYKLVVVGASGVGKSA

SEQ ID NO: 23936 - protein, 18 aa, Homo sapiens
  Native (KRAS G12S)
TEYKLVVVGASGVGKSAL

SEQ ID NO: 23937 - protein, 19 aa, Homo sapiens
  Native (KRAS G12S)
TEYKLVVVGASGVGKSALT

SEQ ID NO: 23938 - protein, 20 aa, Homo sapiens
  Native (KRAS G12S)
TEYKLVVVGASGVGKSALTI

SEQ ID NO: 23939 - protein, 21 aa, Homo sapiens
  Native (KRAS G12S)
TEYKLVVVGASGVGKSALTIQ

SEQ ID NO: 23940 - protein, 22 aa, Homo sapiens
  Native (KRAS G12S)
TEYKLVVVGASGVGKSALTIQL

SEQ ID NO: 23941 - protein, 23 aa, Homo sapiens
  Native (KRAS G12S)
TEYKLVVVGASGVGKSALTIQLI

SEQ ID NO: 23942 - protein, 24 aa, Homo sapiens
  Native (KRAS G12S)
TEYKLVVVGASGVGKSALTIQLIQ

SEQ ID NO: 23943 - protein, 25 aa, Homo sapiens
  Native (KRAS G12S)
TEYKLVVVGASGVGKSALTIQLIQN

SEQ ID NO: 23944 - protein, 15 aa, Homo sapiens
  Native (KRAS G12S)
VVVGASGVGKSALTI

SEQ ID NO: 23945 - protein, 13 aa, Homo sapiens
  Native (KRAS G12S)
YKLVVVGASGVGK

SEQ ID NO: 23946 - protein, 14 aa, Homo sapiens
  Native (KRAS G12S)
YKLVVVGASGVGKS

SEQ ID NO: 23947 - protein, 15 aa, Homo sapiens
  Native (KRAS G12S)
YKLVVVGASGVGKSA

SEQ ID NO: 23948 - protein, 16 aa, Homo sapiens
  Native (KRAS G12S)
YKLVVVGASGVGKSAL

SEQ ID NO: 23949 - protein, 17 aa, Homo sapiens
  Native (KRAS G12S)
YKLVVVGASGVGKSALT

SEQ ID NO: 23950 - protein, 18 aa, Homo sapiens
  Native (KRAS G12S)
YKLVVVGASGVGKSALTI

SEQ ID NO: 23951 - protein, 19 aa, Homo sapiens
  Native (KRAS G12S)
YKLVVVGASGVGKSALTIQ

SEQ ID NO: 23952 - protein, 20 aa, Homo sapiens
  Native (KRAS G12S)
YKLVVVGASGVGKSALTIQL

SEQ ID NO: 23953 - protein, 21 aa, Homo sapiens
  Native (KRAS G12S)
YKLVVVGASGVGKSALTIQLI

SEQ ID NO: 23954 - protein, 22 aa, Homo sapiens
  Native (KRAS G12S)
YKLVVVGASGVGKSALTIQLIQ

SEQ ID NO: 23955 - protein, 23 aa, Homo sapiens
  Native (KRAS G12S)
YKLVVVGASGVGKSALTIQLIQN

SEQ ID NO: 23956 - protein, 24 aa, Homo sapiens
  Native (KRAS G12S)
YKLVVVGASGVGKSALTIQLIQNH

SEQ ID NO: 23957 - protein, 25 aa, Homo sapiens
  Native (KRAS G12S)
YKLVVVGASGVGKSALTIQLIQNHF

SEQ ID NO: 23958 - protein, 13 aa, Homo sapiens
  Native (KRAS G12V)
EYKLVVVGAVGVG

SEQ ID NO: 23959 - protein, 14 aa, Homo sapiens
  Native (KRAS G12V)
EYKLVVVGAVGVGK

SEQ ID NO: 23960 - protein, 15 aa, Homo sapiens
  Native (KRAS G12V)
EYKLVVVGAVGVGKS

SEQ ID NO: 23961 - protein, 16 aa, Homo sapiens
  Native (KRAS G12V)
EYKLVVVGAVGVGKSA

SEQ ID NO: 23962 - protein, 17 aa, Homo sapiens
  Native (KRAS G12V)
EYKLVVVGAVGVGKSAL

SEQ ID NO: 23963 - protein, 18 aa, Homo sapiens
  Native (KRAS G12V)
EYKLVVVGAVGVGKSALT

SEQ ID NO: 23964 - protein, 19 aa, Homo sapiens
  Native (KRAS G12V)
EYKLVVVGAVGVGKSALTI

SEQ ID NO: 23965 - protein, 20 aa, Homo sapiens
  Native (KRAS G12V)
EYKLVVVGAVGVGKSALTIQ

SEQ ID NO: 23966 - protein, 21 aa, Homo sapiens
  Native (KRAS G12V)
EYKLVVVGAVGVGKSALTIQL

SEQ ID NO: 23967 - protein, 22 aa, Homo sapiens
  Native (KRAS G12V)
EYKLVVVGAVGVGKSALTIQLI

SEQ ID NO: 23968 - protein, 23 aa, Homo sapiens
  Native (KRAS G12V)
EYKLVVVGAVGVGKSALTIQLIQ

SEQ ID NO: 23969 - protein, 24 aa, Homo sapiens
  Native (KRAS G12V)
EYKLVVVGAVGVGKSALTIQLIQN

SEQ ID NO: 23970 - protein, 25 aa, Homo sapiens
  Native (KRAS G12V)
EYKLVVVGAVGVGKSALTIQLIQNH

SEQ ID NO: 23971 - protein, 13 aa, Homo sapiens
  Native (KRAS G12V)
KLVVVGAVGVGKS

SEQ ID NO: 23972 - protein, 14 aa, Homo sapiens
  Native (KRAS G12V)
KLVVVGAVGVGKSA

SEQ ID NO: 23973 - protein, 15 aa, Homo sapiens
  Native (KRAS G12V)
KLVVVGAVGVGKSAL

SEQ ID NO: 23974 - protein, 16 aa, Homo sapiens
  Native (KRAS G12V)
KLVVVGAVGVGKSALT

SEQ ID NO: 23975 - protein, 17 aa, Homo sapiens
  Native (KRAS G12V)
KLVVVGAVGVGKSALTI

SEQ ID NO: 23976 - protein, 18 aa, Homo sapiens
  Native (KRAS G12V)
KLVVVGAVGVGKSALTIQ

SEQ ID NO: 23977 - protein, 19 aa, Homo sapiens
  Native (KRAS G12V)
KLVVVGAVGVGKSALTIQL

SEQ ID NO: 23978 - protein, 20 aa, Homo sapiens
  Native (KRAS G12V)
KLVVVGAVGVGKSALTIQLI

SEQ ID NO: 23979 - protein, 21 aa, Homo sapiens
  Native (KRAS G12V)
KLVVVGAVGVGKSALTIQLIQ

SEQ ID NO: 23980 - protein, 22 aa, Homo sapiens
  Native (KRAS G12V)
KLVVVGAVGVGKSALTIQLIQN

SEQ ID NO: 23981 - protein, 23 aa, Homo sapiens
  Native (KRAS G12V)
KLVVVGAVGVGKSALTIQLIQNH

SEQ ID NO: 23982 - protein, 24 aa, Homo sapiens
  Native (KRAS G12V)
KLVVVGAVGVGKSALTIQLIQNHF

SEQ ID NO: 23983 - protein, 25 aa, Homo sapiens
  Native (KRAS G12V)
KLVVVGAVGVGKSALTIQLIQNHFV

SEQ ID NO: 23984 - protein, 14 aa, Homo sapiens
  Native (KRAS G12V)
LVVVGAVGVGKSAL

SEQ ID NO: 23985 - protein, 15 aa, Homo sapiens
  Native (KRAS G12V)
LVVVGAVGVGKSALT

SEQ ID NO: 23986 - protein, 17 aa, Homo sapiens
  Native (KRAS G12V)
LVVVGAVGVGKSALTIQ

SEQ ID NO: 23987 - protein, 14 aa, Homo sapiens
  Native (KRAS G12V)
MTEYKLVVVGAVGV

SEQ ID NO: 23988 - protein, 15 aa, Homo sapiens
  Native (KRAS G12V)
MTEYKLVVVGAVGVG

SEQ ID NO: 23989 - protein, 16 aa, Homo sapiens
  Native (KRAS G12V)
MTEYKLVVVGAVGVGK

SEQ ID NO: 23990 - protein, 17 aa, Homo sapiens
  Native (KRAS G12V)
MTEYKLVVVGAVGVGKS

SEQ ID NO: 23991 - protein, 18 aa, Homo sapiens
  Native (KRAS G12V)
MTEYKLVVVGAVGVGKSA

SEQ ID NO: 23992 - protein, 19 aa, Homo sapiens
  Native (KRAS G12V)
MTEYKLVVVGAVGVGKSAL

SEQ ID NO: 23993 - protein, 20 aa, Homo sapiens
  Native (KRAS G12V)
MTEYKLVVVGAVGVGKSALT

SEQ ID NO: 23994 - protein, 21 aa, Homo sapiens
  Native (KRAS G12V)
MTEYKLVVVGAVGVGKSALTI

SEQ ID NO: 23995 - protein, 22 aa, Homo sapiens
  Native (KRAS G12V)
MTEYKLVVVGAVGVGKSALTIQ

SEQ ID NO: 23996 - protein, 23 aa, Homo sapiens
  Native (KRAS G12V)
MTEYKLVVVGAVGVGKSALTIQL

SEQ ID NO: 23997 - protein, 24 aa, Homo sapiens
  Native (KRAS G12V)
MTEYKLVVVGAVGVGKSALTIQLI

SEQ ID NO: 23998 - protein, 25 aa, Homo sapiens
  Native (KRAS G12V)
MTEYKLVVVGAVGVGKSALTIQLIQ

SEQ ID NO: 23999 - protein, 13 aa, Homo sapiens
  Native (KRAS G12V)
TEYKLVVVGAVGV

SEQ ID NO: 24000 - protein, 14 aa, Homo sapiens
  Native (KRAS G12V)
TEYKLVVVGAVGVG

SEQ ID NO: 24001 - protein, 15 aa, Homo sapiens
  Native (KRAS G12V)
TEYKLVVVGAVGVGK

SEQ ID NO: 24002 - protein, 16 aa, Homo sapiens
  Native (KRAS G12V)
TEYKLVVVGAVGVGKS

SEQ ID NO: 24003 - protein, 17 aa, Homo sapiens
  Native (KRAS G12V)
TEYKLVVVGAVGVGKSA

SEQ ID NO: 24004 - protein, 18 aa, Homo sapiens
  Native (KRAS G12V)
TEYKLVVVGAVGVGKSAL

SEQ ID NO: 24005 - protein, 19 aa, Homo sapiens
  Native (KRAS G12V)
TEYKLVVVGAVGVGKSALT

SEQ ID NO: 24006 - protein, 20 aa, Homo sapiens
  Native (KRAS G12V)
TEYKLVVVGAVGVGKSALTI

SEQ ID NO: 24007 - protein, 21 aa, Homo sapiens
  Native (KRAS G12V)
TEYKLVVVGAVGVGKSALTIQ

SEQ ID NO: 24008 - protein, 22 aa, Homo sapiens
  Native (KRAS G12V)
TEYKLVVVGAVGVGKSALTIQL

SEQ ID NO: 24009 - protein, 23 aa, Homo sapiens
  Native (KRAS G12V)
TEYKLVVVGAVGVGKSALTIQLI

SEQ ID NO: 24010 - protein, 24 aa, Homo sapiens
  Native (KRAS G12V)
TEYKLVVVGAVGVGKSALTIQLIQ

SEQ ID NO: 24011 - protein, 25 aa, Homo sapiens
  Native (KRAS G12V)
TEYKLVVVGAVGVGKSALTIQLIQN

SEQ ID NO: 24012 - protein, 15 aa, Homo sapiens
  Native (KRAS G12V)
VVVGAVGVGKSALTI

SEQ ID NO: 24013 - protein, 13 aa, Homo sapiens
  Native (KRAS G12V)
YKLVVVGAVGVGK

SEQ ID NO: 24014 - protein, 14 aa, Homo sapiens
  Native (KRAS G12V)
YKLVVVGAVGVGKS

SEQ ID NO: 24015 - protein, 15 aa, Homo sapiens
  Native (KRAS G12V)
YKLVVVGAVGVGKSA

SEQ ID NO: 24016 - protein, 16 aa, Homo sapiens
  Native (KRAS G12V)
YKLVVVGAVGVGKSAL

SEQ ID NO: 24017 - protein, 17 aa, Homo sapiens
  Native (KRAS G12V)
YKLVVVGAVGVGKSALT

SEQ ID NO: 24018 - protein, 18 aa, Homo sapiens
  Native (KRAS G12V)
YKLVVVGAVGVGKSALTI

SEQ ID NO: 24019 - protein, 19 aa, Homo sapiens
  Native (KRAS G12V)
YKLVVVGAVGVGKSALTIQ

SEQ ID NO: 24020 - protein, 20 aa, Homo sapiens
  Native (KRAS G12V)
YKLVVVGAVGVGKSALTIQL

SEQ ID NO: 24021 - protein, 21 aa, Homo sapiens
  Native (KRAS G12V)
YKLVVVGAVGVGKSALTIQLI

SEQ ID NO: 24022 - protein, 22 aa, Homo sapiens
  Native (KRAS G12V)
YKLVVVGAVGVGKSALTIQLIQ

SEQ ID NO: 24023 - protein, 23 aa, Homo sapiens
  Native (KRAS G12V)
YKLVVVGAVGVGKSALTIQLIQN

SEQ ID NO: 24024 - protein, 24 aa, Homo sapiens
  Native (KRAS G12V)
YKLVVVGAVGVGKSALTIQLIQNH

SEQ ID NO: 24025 - protein, 25 aa, Homo sapiens
  Native (KRAS G12V)
YKLVVVGAVGVGKSALTIQLIQNHF

SEQ ID NO: 24026 - protein, 13 aa, Homo sapiens
  Native (KRAS G13D)
EYKLVVVGAGDVG

SEQ ID NO: 24027 - protein, 14 aa, Homo sapiens
  Native (KRAS G13D)
EYKLVVVGAGDVGK

SEQ ID NO: 24028 - protein, 15 aa, Homo sapiens
  Native (KRAS G13D)
EYKLVVVGAGDVGKS

SEQ ID NO: 24029 - protein, 16 aa, Homo sapiens
  Native (KRAS G13D)
EYKLVVVGAGDVGKSA

SEQ ID NO: 24030 - protein, 17 aa, Homo sapiens
  Native (KRAS G13D)
EYKLVVVGAGDVGKSAL

SEQ ID NO: 24031 - protein, 18 aa, Homo sapiens
  Native (KRAS G13D)
EYKLVVVGAGDVGKSALT

SEQ ID NO: 24032 - protein, 19 aa, Homo sapiens
  Native (KRAS G13D)
EYKLVVVGAGDVGKSALTI

SEQ ID NO: 24033 - protein, 20 aa, Homo sapiens
  Native (KRAS G13D)
EYKLVVVGAGDVGKSALTIQ

SEQ ID NO: 24034 - protein, 21 aa, Homo sapiens
  Native (KRAS G13D)
EYKLVVVGAGDVGKSALTIQL

SEQ ID NO: 24035 - protein, 22 aa, Homo sapiens
  Native (KRAS G13D)
EYKLVVVGAGDVGKSALTIQLI

SEQ ID NO: 24036 - protein, 23 aa, Homo sapiens
  Native (KRAS G13D)
EYKLVVVGAGDVGKSALTIQLIQ

SEQ ID NO: 24037 - protein, 24 aa, Homo sapiens
  Native (KRAS G13D)
EYKLVVVGAGDVGKSALTIQLIQN

SEQ ID NO: 24038 - protein, 25 aa, Homo sapiens
  Native (KRAS G13D)
EYKLVVVGAGDVGKSALTIQLIQNH

SEQ ID NO: 24039 - protein, 13 aa, Homo sapiens
  Native (KRAS G13D)
KLVVVGAGDVGKS

SEQ ID NO: 24040 - protein, 14 aa, Homo sapiens
  Native (KRAS G13D)
KLVVVGAGDVGKSA

SEQ ID NO: 24041 - protein, 15 aa, Homo sapiens
  Native (KRAS G13D)
KLVVVGAGDVGKSAL

SEQ ID NO: 24042 - protein, 16 aa, Homo sapiens
  Native (KRAS G13D)
KLVVVGAGDVGKSALT

SEQ ID NO: 24043 - protein, 17 aa, Homo sapiens
  Native (KRAS G13D)
KLVVVGAGDVGKSALTI

SEQ ID NO: 24044 - protein, 18 aa, Homo sapiens
  Native (KRAS G13D)
KLVVVGAGDVGKSALTIQ

SEQ ID NO: 24045 - protein, 19 aa, Homo sapiens
  Native (KRAS G13D)
KLVVVGAGDVGKSALTIQL

SEQ ID NO: 24046 - protein, 20 aa, Homo sapiens
  Native (KRAS G13D)
KLVVVGAGDVGKSALTIQLI

SEQ ID NO: 24047 - protein, 21 aa, Homo sapiens
  Native (KRAS G13D)
KLVVVGAGDVGKSALTIQLIQ

SEQ ID NO: 24048 - protein, 22 aa, Homo sapiens
  Native (KRAS G13D)
KLVVVGAGDVGKSALTIQLIQN

SEQ ID NO: 24049 - protein, 23 aa, Homo sapiens
  Native (KRAS G13D)
KLVVVGAGDVGKSALTIQLIQNH

SEQ ID NO: 24050 - protein, 24 aa, Homo sapiens
  Native (KRAS G13D)
KLVVVGAGDVGKSALTIQLIQNHF

SEQ ID NO: 24051 - protein, 25 aa, Homo sapiens
  Native (KRAS G13D)
KLVVVGAGDVGKSALTIQLIQNHFV

SEQ ID NO: 24052 - protein, 13 aa, Homo sapiens
  Native (KRAS G13D)
LVVVGAGDVGKSA

SEQ ID NO: 24053 - protein, 14 aa, Homo sapiens
  Native (KRAS G13D)
LVVVGAGDVGKSAL

SEQ ID NO: 24054 - protein, 15 aa, Homo sapiens
  Native (KRAS G13D)
LVVVGAGDVGKSALT

SEQ ID NO: 24055 - protein, 16 aa, Homo sapiens
  Native (KRAS G13D)
LVVVGAGDVGKSALTI

SEQ ID NO: 24056 - protein, 17 aa, Homo sapiens
  Native (KRAS G13D)
LVVVGAGDVGKSALTIQ

SEQ ID NO: 24057 - protein, 18 aa, Homo sapiens
  Native (KRAS G13D)
LVVVGAGDVGKSALTIQL

SEQ ID NO: 24058 - protein, 19 aa, Homo sapiens
  Native (KRAS G13D)
LVVVGAGDVGKSALTIQLI

SEQ ID NO: 24059 - protein, 20 aa, Homo sapiens
  Native (KRAS G13D)
LVVVGAGDVGKSALTIQLIQ

SEQ ID NO: 24060 - protein, 21 aa, Homo sapiens
  Native (KRAS G13D)
LVVVGAGDVGKSALTIQLIQN

SEQ ID NO: 24061 - protein, 22 aa, Homo sapiens
  Native (KRAS G13D)
LVVVGAGDVGKSALTIQLIQNH

SEQ ID NO: 24062 - protein, 23 aa, Homo sapiens
  Native (KRAS G13D)
LVVVGAGDVGKSALTIQLIQNHF

SEQ ID NO: 24063 - protein, 24 aa, Homo sapiens
  Native (KRAS G13D)
LVVVGAGDVGKSALTIQLIQNHFV

SEQ ID NO: 24064 - protein, 25 aa, Homo sapiens
  Native (KRAS G13D)
LVVVGAGDVGKSALTIQLIQNHFVD

SEQ ID NO: 24065 - protein, 14 aa, Homo sapiens
  Native (KRAS G13D)
MTEYKLVVVGAGDV

SEQ ID NO: 24066 - protein, 15 aa, Homo sapiens
  Native (KRAS G13D)
MTEYKLVVVGAGDVG

SEQ ID NO: 24067 - protein, 16 aa, Homo sapiens
  Native (KRAS G13D)
MTEYKLVVVGAGDVGK

SEQ ID NO: 24068 - protein, 17 aa, Homo sapiens
  Native (KRAS G13D)
MTEYKLVVVGAGDVGKS

SEQ ID NO: 24069 - protein, 18 aa, Homo sapiens
  Native (KRAS G13D)
MTEYKLVVVGAGDVGKSA

SEQ ID NO: 24070 - protein, 19 aa, Homo sapiens
  Native (KRAS G13D)
MTEYKLVVVGAGDVGKSAL

SEQ ID NO: 24071 - protein, 20 aa, Homo sapiens
  Native (KRAS G13D)
MTEYKLVVVGAGDVGKSALT

SEQ ID NO: 24072 - protein, 21 aa, Homo sapiens
  Native (KRAS G13D)
MTEYKLVVVGAGDVGKSALTI

SEQ ID NO: 24073 - protein, 22 aa, Homo sapiens
  Native (KRAS G13D)
MTEYKLVVVGAGDVGKSALTIQ

SEQ ID NO: 24074 - protein, 23 aa, Homo sapiens
  Native (KRAS G13D)
MTEYKLVVVGAGDVGKSALTIQL

SEQ ID NO: 24075 - protein, 24 aa, Homo sapiens
  Native (KRAS G13D)
MTEYKLVVVGAGDVGKSALTIQLI

SEQ ID NO: 24076 - protein, 25 aa, Homo sapiens
  Native (KRAS G13D)
MTEYKLVVVGAGDVGKSALTIQLIQ

SEQ ID NO: 24077 - protein, 14 aa, Homo sapiens
  Native (KRAS G13D)
TEYKLVVVGAGDVG

SEQ ID NO: 24078 - protein, 15 aa, Homo sapiens
  Native (KRAS G13D)
TEYKLVVVGAGDVGK

SEQ ID NO: 24079 - protein, 16 aa, Homo sapiens
  Native (KRAS G13D)
TEYKLVVVGAGDVGKS

SEQ ID NO: 24080 - protein, 17 aa, Homo sapiens
  Native (KRAS G13D)
TEYKLVVVGAGDVGKSA

SEQ ID NO: 24081 - protein, 18 aa, Homo sapiens
  Native (KRAS G13D)
TEYKLVVVGAGDVGKSAL

SEQ ID NO: 24082 - protein, 19 aa, Homo sapiens
  Native (KRAS G13D)
TEYKLVVVGAGDVGKSALT

SEQ ID NO: 24083 - protein, 20 aa, Homo sapiens
  Native (KRAS G13D)
TEYKLVVVGAGDVGKSALTI

SEQ ID NO: 24084 - protein, 21 aa, Homo sapiens
  Native (KRAS G13D)
TEYKLVVVGAGDVGKSALTIQ

SEQ ID NO: 24085 - protein, 22 aa, Homo sapiens
  Native (KRAS G13D)
TEYKLVVVGAGDVGKSALTIQL

SEQ ID NO: 24086 - protein, 23 aa, Homo sapiens
  Native (KRAS G13D)
TEYKLVVVGAGDVGKSALTIQLI

SEQ ID NO: 24087 - protein, 24 aa, Homo sapiens
  Native (KRAS G13D)
TEYKLVVVGAGDVGKSALTIQLIQ

SEQ ID NO: 24088 - protein, 25 aa, Homo sapiens
  Native (KRAS G13D)
TEYKLVVVGAGDVGKSALTIQLIQN

SEQ ID NO: 24089 - protein, 14 aa, Homo sapiens
  Native (KRAS G13D)
VGAGDVGKSALTIQ

SEQ ID NO: 24090 - protein, 15 aa, Homo sapiens
  Native (KRAS G13D)
VGAGDVGKSALTIQL

SEQ ID NO: 24091 - protein, 16 aa, Homo sapiens
  Native (KRAS G13D)
VGAGDVGKSALTIQLI

SEQ ID NO: 24092 - protein, 13 aa, Homo sapiens
  Native (KRAS G13D)
VVGAGDVGKSALT

SEQ ID NO: 24093 - protein, 14 aa, Homo sapiens
  Native (KRAS G13D)
VVGAGDVGKSALTI

SEQ ID NO: 24094 - protein, 15 aa, Homo sapiens
  Native (KRAS G13D)
VVGAGDVGKSALTIQ

SEQ ID NO: 24095 - protein, 16 aa, Homo sapiens
  Native (KRAS G13D)
VVGAGDVGKSALTIQL

SEQ ID NO: 24096 - protein, 17 aa, Homo sapiens
  Native (KRAS G13D)
VVGAGDVGKSALTIQLI

SEQ ID NO: 24097 - protein, 18 aa, Homo sapiens
  Native (KRAS G13D)
VVGAGDVGKSALTIQLIQ

SEQ ID NO: 24098 - protein, 19 aa, Homo sapiens
  Native (KRAS G13D)
VVGAGDVGKSALTIQLIQN

SEQ ID NO: 24099 - protein, 20 aa, Homo sapiens
  Native (KRAS G13D)
VVGAGDVGKSALTIQLIQNH

SEQ ID NO: 24100 - protein, 21 aa, Homo sapiens
  Native (KRAS G13D)
VVGAGDVGKSALTIQLIQNHF

SEQ ID NO: 24101 - protein, 22 aa, Homo sapiens
  Native (KRAS G13D)
VVGAGDVGKSALTIQLIQNHFV

SEQ ID NO: 24102 - protein, 23 aa, Homo sapiens
  Native (KRAS G13D)
VVGAGDVGKSALTIQLIQNHFVD

SEQ ID NO: 24103 - protein, 24 aa, Homo sapiens
  Native (KRAS G13D)
VVGAGDVGKSALTIQLIQNHFVDE

SEQ ID NO: 24104 - protein, 25 aa, Homo sapiens
  Native (KRAS G13D)
VVGAGDVGKSALTIQLIQNHFVDEY

SEQ ID NO: 24105 - protein, 13 aa, Homo sapiens
  Native (KRAS G13D)
VVVGAGDVGKSAL

SEQ ID NO: 24106 - protein, 14 aa, Homo sapiens
  Native (KRAS G13D)
VVVGAGDVGKSALT

SEQ ID NO: 24107 - protein, 15 aa, Homo sapiens
  Native (KRAS G13D)
VVVGAGDVGKSALTI

SEQ ID NO: 24108 - protein, 16 aa, Homo sapiens
  Native (KRAS G13D)
VVVGAGDVGKSALTIQ

SEQ ID NO: 24109 - protein, 17 aa, Homo sapiens
  Native (KRAS G13D)
VVVGAGDVGKSALTIQL

SEQ ID NO: 24110 - protein, 18 aa, Homo sapiens
  Native (KRAS G13D)
VVVGAGDVGKSALTIQLI

SEQ ID NO: 24111 - protein, 19 aa, Homo sapiens
  Native (KRAS G13D)
VVVGAGDVGKSALTIQLIQ

SEQ ID NO: 24112 - protein, 20 aa, Homo sapiens
  Native (KRAS G13D)
VVVGAGDVGKSALTIQLIQN

SEQ ID NO: 24113 - protein, 21 aa, Homo sapiens
  Native (KRAS G13D)
VVVGAGDVGKSALTIQLIQNH

SEQ ID NO: 24114 - protein, 22 aa, Homo sapiens
  Native (KRAS G13D)
VVVGAGDVGKSALTIQLIQNHF

SEQ ID NO: 24115 - protein, 23 aa, Homo sapiens
  Native (KRAS G13D)
VVVGAGDVGKSALTIQLIQNHFV

SEQ ID NO: 24116 - protein, 24 aa, Homo sapiens
  Native (KRAS G13D)
VVVGAGDVGKSALTIQLIQNHFVD

SEQ ID NO: 24117 - protein, 25 aa, Homo sapiens
  Native (KRAS G13D)
VVVGAGDVGKSALTIQLIQNHFVDE

SEQ ID NO: 24118 - protein, 13 aa, Homo sapiens
  Native (KRAS G13D)
YKLVVVGAGDVGK

SEQ ID NO: 24119 - protein, 14 aa, Homo sapiens
  Native (KRAS G13D)
YKLVVVGAGDVGKS

SEQ ID NO: 24120 - protein, 16 aa, Homo sapiens
  Native (KRAS G13D)
YKLVVVGAGDVGKSAL

SEQ ID NO: 24121 - protein, 17 aa, Homo sapiens
  Native (KRAS G13D)
YKLVVVGAGDVGKSALT

SEQ ID NO: 24122 - protein, 18 aa, Homo sapiens
  Native (KRAS G13D)
YKLVVVGAGDVGKSALTI

SEQ ID NO: 24123 - protein, 19 aa, Homo sapiens
  Native (KRAS G13D)
YKLVVVGAGDVGKSALTIQ

SEQ ID NO: 24124 - protein, 20 aa, Homo sapiens
  Native (KRAS G13D)
YKLVVVGAGDVGKSALTIQL

SEQ ID NO: 24125 - protein, 21 aa, Homo sapiens
  Native (KRAS G13D)
YKLVVVGAGDVGKSALTIQLI

SEQ ID NO: 24126 - protein, 22 aa, Homo sapiens
  Native (KRAS G13D)
YKLVVVGAGDVGKSALTIQLIQ

SEQ ID NO: 24127 - protein, 23 aa, Homo sapiens
  Native (KRAS G13D)
YKLVVVGAGDVGKSALTIQLIQN

SEQ ID NO: 24128 - protein, 24 aa, Homo sapiens
  Native (KRAS G13D)
YKLVVVGAGDVGKSALTIQLIQNH

SEQ ID NO: 24129 - protein, 25 aa, Homo sapiens
  Native (KRAS G13D)
YKLVVVGAGDVGKSALTIQLIQNHF

SEQ ID NO: 24130 - protein, 20 aa, Homo sapiens
  Native (NRAS Q61K)
CLLDILDTAGKEEYSAMRDQ

SEQ ID NO: 24131 - protein, 22 aa, Homo sapiens
  Native (NRAS Q61K)
CLLDILDTAGKEEYSAMRDQYM

SEQ ID NO: 24132 - protein, 19 aa, Homo sapiens
  Native (NRAS Q61K)
DGETCLLDILDTAGKEEYS

SEQ ID NO: 24133 - protein, 20 aa, Homo sapiens
  Native (NRAS Q61K)
DGETCLLDILDTAGKEEYSA

SEQ ID NO: 24134 - protein, 21 aa, Homo sapiens
  Native (NRAS Q61K)
DGETCLLDILDTAGKEEYSAM

SEQ ID NO: 24135 - protein, 22 aa, Homo sapiens
  Native (NRAS Q61K)
DGETCLLDILDTAGKEEYSAMR

SEQ ID NO: 24136 - protein, 23 aa, Homo sapiens
  Native (NRAS Q61K)
DGETCLLDILDTAGKEEYSAMRD

SEQ ID NO: 24137 - protein, 24 aa, Homo sapiens
  Native (NRAS Q61K)
DGETCLLDILDTAGKEEYSAMRDQ

SEQ ID NO: 24138 - protein, 25 aa, Homo sapiens
  Native (NRAS Q61K)
DGETCLLDILDTAGKEEYSAMRDQY

SEQ ID NO: 24139 - protein, 15 aa, Homo sapiens
  Native (NRAS Q61K)
ETCLLDILDTAGKEE

SEQ ID NO: 24140 - protein, 16 aa, Homo sapiens
  Native (NRAS Q61K)
ETCLLDILDTAGKEEY

SEQ ID NO: 24141 - protein, 17 aa, Homo sapiens
  Native (NRAS Q61K)
ETCLLDILDTAGKEEYS

SEQ ID NO: 24142 - protein, 19 aa, Homo sapiens
  Native (NRAS Q61K)
ETCLLDILDTAGKEEYSAM

SEQ ID NO: 24143 - protein, 20 aa, Homo sapiens
  Native (NRAS Q61K)
ETCLLDILDTAGKEEYSAMR

SEQ ID NO: 24144 - protein, 21 aa, Homo sapiens
  Native (NRAS Q61K)
ETCLLDILDTAGKEEYSAMRD

SEQ ID NO: 24145 - protein, 22 aa, Homo sapiens
  Native (NRAS Q61K)
ETCLLDILDTAGKEEYSAMRDQ

SEQ ID NO: 24146 - protein, 23 aa, Homo sapiens
  Native (NRAS Q61K)
ETCLLDILDTAGKEEYSAMRDQY

SEQ ID NO: 24147 - protein, 24 aa, Homo sapiens
  Native (NRAS Q61K)
ETCLLDILDTAGKEEYSAMRDQYM

SEQ ID NO: 24148 - protein, 16 aa, Homo sapiens
  Native (NRAS Q61K)
GETCLLDILDTAGKEE

SEQ ID NO: 24149 - protein, 17 aa, Homo sapiens
  Native (NRAS Q61K)
GETCLLDILDTAGKEEY

SEQ ID NO: 24150 - protein, 19 aa, Homo sapiens
  Native (NRAS Q61K)
GETCLLDILDTAGKEEYSA

SEQ ID NO: 24151 - protein, 20 aa, Homo sapiens
  Native (NRAS Q61K)
GETCLLDILDTAGKEEYSAM

SEQ ID NO: 24152 - protein, 21 aa, Homo sapiens
  Native (NRAS Q61K)
GETCLLDILDTAGKEEYSAMR

SEQ ID NO: 24153 - protein, 22 aa, Homo sapiens
  Native (NRAS Q61K)
GETCLLDILDTAGKEEYSAMRD

SEQ ID NO: 24154 - protein, 23 aa, Homo sapiens
  Native (NRAS Q61K)
GETCLLDILDTAGKEEYSAMRDQ

SEQ ID NO: 24155 - protein, 24 aa, Homo sapiens
  Native (NRAS Q61K)
GETCLLDILDTAGKEEYSAMRDQY

SEQ ID NO: 24156 - protein, 25 aa, Homo sapiens
  Native (NRAS Q61K)
GETCLLDILDTAGKEEYSAMRDQYM

SEQ ID NO: 24157 - protein, 19 aa, Homo sapiens
  Native (NRAS Q61K)
IDGETCLLDILDTAGKEEY

SEQ ID NO: 24158 - protein, 20 aa, Homo sapiens
  Native (NRAS Q61K)
IDGETCLLDILDTAGKEEYS

SEQ ID NO: 24159 - protein, 21 aa, Homo sapiens
  Native (NRAS Q61K)
IDGETCLLDILDTAGKEEYSA

SEQ ID NO: 24160 - protein, 22 aa, Homo sapiens
  Native (NRAS Q61K)
IDGETCLLDILDTAGKEEYSAM

SEQ ID NO: 24161 - protein, 23 aa, Homo sapiens
  Native (NRAS Q61K)
IDGETCLLDILDTAGKEEYSAMR

SEQ ID NO: 24162 - protein, 24 aa, Homo sapiens
  Native (NRAS Q61K)
IDGETCLLDILDTAGKEEYSAMRD

SEQ ID NO: 24163 - protein, 25 aa, Homo sapiens
  Native (NRAS Q61K)
IDGETCLLDILDTAGKEEYSAMRDQ

SEQ ID NO: 24164 - protein, 24 aa, Homo sapiens
  Native (NRAS Q61K)
KQVVIDGETCLLDILDTAGKEEYS

SEQ ID NO: 24165 - protein, 25 aa, Homo sapiens
  Native (NRAS Q61K)
KQVVIDGETCLLDILDTAGKEEYSA

SEQ ID NO: 24166 - protein, 20 aa, Homo sapiens
  Native (NRAS Q61K)
LDILDTAGKEEYSAMRDQYM

SEQ ID NO: 24167 - protein, 15 aa, Homo sapiens
  Native (NRAS Q61K)
LLDILDTAGKEEYSA

SEQ ID NO: 24168 - protein, 16 aa, Homo sapiens
  Native (NRAS Q61K)
LLDILDTAGKEEYSAM

SEQ ID NO: 24169 - protein, 20 aa, Homo sapiens
  Native (NRAS Q61K)
LLDILDTAGKEEYSAMRDQY

SEQ ID NO: 24170 - protein, 21 aa, Homo sapiens
  Native (NRAS Q61K)
LLDILDTAGKEEYSAMRDQYM

SEQ ID NO: 24171 - protein, 22 aa, Homo sapiens
  Native (NRAS Q61K)
QVVIDGETCLLDILDTAGKEEY

SEQ ID NO: 24172 - protein, 23 aa, Homo sapiens
  Native (NRAS Q61K)
QVVIDGETCLLDILDTAGKEEYS

SEQ ID NO: 24173 - protein, 24 aa, Homo sapiens
  Native (NRAS Q61K)
QVVIDGETCLLDILDTAGKEEYSA

SEQ ID NO: 24174 - protein, 25 aa, Homo sapiens
  Native (NRAS Q61K)
QVVIDGETCLLDILDTAGKEEYSAM

SEQ ID NO: 24175 - protein, 25 aa, Homo sapiens
  Native (NRAS Q61K)
RKQVVIDGETCLLDILDTAGKEEYS

SEQ ID NO: 24176 - protein, 15 aa, Homo sapiens
  Native (NRAS Q61K)
TCLLDILDTAGKEEY

SEQ ID NO: 24177 - protein, 16 aa, Homo sapiens
  Native (NRAS Q61K)
TCLLDILDTAGKEEYS

SEQ ID NO: 24178 - protein, 17 aa, Homo sapiens
  Native (NRAS Q61K)
TCLLDILDTAGKEEYSA

SEQ ID NO: 24179 - protein, 19 aa, Homo sapiens
  Native (NRAS Q61K)
TCLLDILDTAGKEEYSAMR

SEQ ID NO: 24180 - protein, 20 aa, Homo sapiens
  Native (NRAS Q61K)
TCLLDILDTAGKEEYSAMRD

SEQ ID NO: 24181 - protein, 23 aa, Homo sapiens
  Native (NRAS Q61K)
TCLLDILDTAGKEEYSAMRDQYM

SEQ ID NO: 24182 - protein, 19 aa, Homo sapiens
  Native (NRAS Q61K)
VIDGETCLLDILDTAGKEE

SEQ ID NO: 24183 - protein, 20 aa, Homo sapiens
  Native (NRAS Q61K)
VIDGETCLLDILDTAGKEEY

SEQ ID NO: 24184 - protein, 21 aa, Homo sapiens
  Native (NRAS Q61K)
VIDGETCLLDILDTAGKEEYS

SEQ ID NO: 24185 - protein, 22 aa, Homo sapiens
  Native (NRAS Q61K)
VIDGETCLLDILDTAGKEEYSA

SEQ ID NO: 24186 - protein, 23 aa, Homo sapiens
  Native (NRAS Q61K)
VIDGETCLLDILDTAGKEEYSAM

SEQ ID NO: 24187 - protein, 24 aa, Homo sapiens
  Native (NRAS Q61K)
VIDGETCLLDILDTAGKEEYSAMR

SEQ ID NO: 24188 - protein, 25 aa, Homo sapiens
  Native (NRAS Q61K)
VIDGETCLLDILDTAGKEEYSAMRD

SEQ ID NO: 24189 - protein, 20 aa, Homo sapiens
  Native (NRAS Q61K)
VVIDGETCLLDILDTAGKEE

SEQ ID NO: 24190 - protein, 21 aa, Homo sapiens
  Native (NRAS Q61K)
VVIDGETCLLDILDTAGKEEY

SEQ ID NO: 24191 - protein, 22 aa, Homo sapiens
  Native (NRAS Q61K)
VVIDGETCLLDILDTAGKEEYS

SEQ ID NO: 24192 - protein, 23 aa, Homo sapiens
  Native (NRAS Q61K)
VVIDGETCLLDILDTAGKEEYSA

SEQ ID NO: 24193 - protein, 24 aa, Homo sapiens
  Native (NRAS Q61K)
VVIDGETCLLDILDTAGKEEYSAM

SEQ ID NO: 24194 - protein, 25 aa, Homo sapiens
  Native (NRAS Q61K)
VVIDGETCLLDILDTAGKEEYSAMR

SEQ ID NO: 24195 - protein, 14 aa, Homo sapiens
  Native (NRAS Q61L)
CLLDILDTAGLEEY

SEQ ID NO: 24196 - protein, 15 aa, Homo sapiens
  Native (NRAS Q61L)
CLLDILDTAGLEEYS

SEQ ID NO: 24197 - protein, 16 aa, Homo sapiens
  Native (NRAS Q61L)
CLLDILDTAGLEEYSA

SEQ ID NO: 24198 - protein, 17 aa, Homo sapiens
  Native (NRAS Q61L)
CLLDILDTAGLEEYSAM

SEQ ID NO: 24199 - protein, 18 aa, Homo sapiens
  Native (NRAS Q61L)
CLLDILDTAGLEEYSAMR

SEQ ID NO: 24200 - protein, 19 aa, Homo sapiens
  Native (NRAS Q61L)
CLLDILDTAGLEEYSAMRD

SEQ ID NO: 24201 - protein, 20 aa, Homo sapiens
  Native (NRAS Q61L)
CLLDILDTAGLEEYSAMRDQ

SEQ ID NO: 24202 - protein, 21 aa, Homo sapiens
  Native (NRAS Q61L)
CLLDILDTAGLEEYSAMRDQY

SEQ ID NO: 24203 - protein, 17 aa, Homo sapiens
  Native (NRAS Q61L)
DGETCLLDILDTAGLEE

SEQ ID NO: 24204 - protein, 18 aa, Homo sapiens
  Native (NRAS Q61L)
DGETCLLDILDTAGLEEY

SEQ ID NO: 24205 - protein, 19 aa, Homo sapiens
  Native (NRAS Q61L)
DGETCLLDILDTAGLEEYS

SEQ ID NO: 24206 - protein, 20 aa, Homo sapiens
  Native (NRAS Q61L)
DGETCLLDILDTAGLEEYSA

SEQ ID NO: 24207 - protein, 21 aa, Homo sapiens
  Native (NRAS Q61L)
DGETCLLDILDTAGLEEYSAM

SEQ ID NO: 24208 - protein, 22 aa, Homo sapiens
  Native (NRAS Q61L)
DGETCLLDILDTAGLEEYSAMR

SEQ ID NO: 24209 - protein, 23 aa, Homo sapiens
  Native (NRAS Q61L)
DGETCLLDILDTAGLEEYSAMRD

SEQ ID NO: 24210 - protein, 24 aa, Homo sapiens
  Native (NRAS Q61L)
DGETCLLDILDTAGLEEYSAMRDQ

SEQ ID NO: 24211 - protein, 14 aa, Homo sapiens
  Native (NRAS Q61L)
DILDTAGLEEYSAM

SEQ ID NO: 24212 - protein, 15 aa, Homo sapiens
  Native (NRAS Q61L)
DILDTAGLEEYSAMR

SEQ ID NO: 24213 - protein, 16 aa, Homo sapiens
  Native (NRAS Q61L)
DILDTAGLEEYSAMRD

SEQ ID NO: 24214 - protein, 17 aa, Homo sapiens
  Native (NRAS Q61L)
DILDTAGLEEYSAMRDQ

SEQ ID NO: 24215 - protein, 15 aa, Homo sapiens
  Native (NRAS Q61L)
ETCLLDILDTAGLEE

SEQ ID NO: 24216 - protein, 16 aa, Homo sapiens
  Native (NRAS Q61L)
ETCLLDILDTAGLEEY

SEQ ID NO: 24217 - protein, 17 aa, Homo sapiens
  Native (NRAS Q61L)
ETCLLDILDTAGLEEYS

SEQ ID NO: 24218 - protein, 18 aa, Homo sapiens
  Native (NRAS Q61L)
ETCLLDILDTAGLEEYSA

SEQ ID NO: 24219 - protein, 20 aa, Homo sapiens
  Native (NRAS Q61L)
ETCLLDILDTAGLEEYSAMR

SEQ ID NO: 24220 - protein, 21 aa, Homo sapiens
  Native (NRAS Q61L)
ETCLLDILDTAGLEEYSAMRD

SEQ ID NO: 24221 - protein, 22 aa, Homo sapiens
  Native (NRAS Q61L)
ETCLLDILDTAGLEEYSAMRDQ

SEQ ID NO: 24222 - protein, 23 aa, Homo sapiens
  Native (NRAS Q61L)
ETCLLDILDTAGLEEYSAMRDQY

SEQ ID NO: 24223 - protein, 24 aa, Homo sapiens
  Native (NRAS Q61L)
ETCLLDILDTAGLEEYSAMRDQYM

SEQ ID NO: 24224 - protein, 16 aa, Homo sapiens
  Native (NRAS Q61L)
GETCLLDILDTAGLEE

SEQ ID NO: 24225 - protein, 17 aa, Homo sapiens
  Native (NRAS Q61L)
GETCLLDILDTAGLEEY

SEQ ID NO: 24226 - protein, 18 aa, Homo sapiens
  Native (NRAS Q61L)
GETCLLDILDTAGLEEYS

SEQ ID NO: 24227 - protein, 19 aa, Homo sapiens
  Native (NRAS Q61L)
GETCLLDILDTAGLEEYSA

SEQ ID NO: 24228 - protein, 20 aa, Homo sapiens
  Native (NRAS Q61L)
GETCLLDILDTAGLEEYSAM

SEQ ID NO: 24229 - protein, 21 aa, Homo sapiens
  Native (NRAS Q61L)
GETCLLDILDTAGLEEYSAMR

SEQ ID NO: 24230 - protein, 22 aa, Homo sapiens
  Native (NRAS Q61L)
GETCLLDILDTAGLEEYSAMRD

SEQ ID NO: 24231 - protein, 23 aa, Homo sapiens
  Native (NRAS Q61L)
GETCLLDILDTAGLEEYSAMRDQ

SEQ ID NO: 24232 - protein, 25 aa, Homo sapiens
  Native (NRAS Q61L)
GETCLLDILDTAGLEEYSAMRDQYM

SEQ ID NO: 24233 - protein, 18 aa, Homo sapiens
  Native (NRAS Q61L)
IDGETCLLDILDTAGLEE

SEQ ID NO: 24234 - protein, 19 aa, Homo sapiens
  Native (NRAS Q61L)
IDGETCLLDILDTAGLEEY

SEQ ID NO: 24235 - protein, 20 aa, Homo sapiens
  Native (NRAS Q61L)
IDGETCLLDILDTAGLEEYS

SEQ ID NO: 24236 - protein, 21 aa, Homo sapiens
  Native (NRAS Q61L)
IDGETCLLDILDTAGLEEYSA

SEQ ID NO: 24237 - protein, 22 aa, Homo sapiens
  Native (NRAS Q61L)
IDGETCLLDILDTAGLEEYSAM

SEQ ID NO: 24238 - protein, 23 aa, Homo sapiens
  Native (NRAS Q61L)
IDGETCLLDILDTAGLEEYSAMR

SEQ ID NO: 24239 - protein, 24 aa, Homo sapiens
  Native (NRAS Q61L)
IDGETCLLDILDTAGLEEYSAMRD

SEQ ID NO: 24240 - protein, 25 aa, Homo sapiens
  Native (NRAS Q61L)
IDGETCLLDILDTAGLEEYSAMRDQ

SEQ ID NO: 24241 - protein, 15 aa, Homo sapiens
  Native (NRAS Q61L)
ILDTAGLEEYSAMRD

SEQ ID NO: 24242 - protein, 16 aa, Homo sapiens
  Native (NRAS Q61L)
ILDTAGLEEYSAMRDQ

SEQ ID NO: 24243 - protein, 24 aa, Homo sapiens
  Native (NRAS Q61L)
KQVVIDGETCLLDILDTAGLEEYS

SEQ ID NO: 24244 - protein, 25 aa, Homo sapiens
  Native (NRAS Q61L)
KQVVIDGETCLLDILDTAGLEEYSA

SEQ ID NO: 24245 - protein, 15 aa, Homo sapiens
  Native (NRAS Q61L)
LDILDTAGLEEYSAM

SEQ ID NO: 24246 - protein, 16 aa, Homo sapiens
  Native (NRAS Q61L)
LDILDTAGLEEYSAMR

SEQ ID NO: 24247 - protein, 17 aa, Homo sapiens
  Native (NRAS Q61L)
LDILDTAGLEEYSAMRD

SEQ ID NO: 24248 - protein, 19 aa, Homo sapiens
  Native (NRAS Q61L)
LDILDTAGLEEYSAMRDQY

SEQ ID NO: 24249 - protein, 20 aa, Homo sapiens
  Native (NRAS Q61L)
LDILDTAGLEEYSAMRDQYM

SEQ ID NO: 24250 - protein, 13 aa, Homo sapiens
  Native (NRAS Q61L)
LLDILDTAGLEEY

SEQ ID NO: 24251 - protein, 15 aa, Homo sapiens
  Native (NRAS Q61L)
LLDILDTAGLEEYSA

SEQ ID NO: 24252 - protein, 16 aa, Homo sapiens
  Native (NRAS Q61L)
LLDILDTAGLEEYSAM

SEQ ID NO: 24253 - protein, 17 aa, Homo sapiens
  Native (NRAS Q61L)
LLDILDTAGLEEYSAMR

SEQ ID NO: 24254 - protein, 19 aa, Homo sapiens
  Native (NRAS Q61L)
LLDILDTAGLEEYSAMRDQ

SEQ ID NO: 24255 - protein, 20 aa, Homo sapiens
  Native (NRAS Q61L)
LLDILDTAGLEEYSAMRDQY

SEQ ID NO: 24256 - protein, 22 aa, Homo sapiens
  Native (NRAS Q61L)
QVVIDGETCLLDILDTAGLEEY

SEQ ID NO: 24257 - protein, 23 aa, Homo sapiens
  Native (NRAS Q61L)
QVVIDGETCLLDILDTAGLEEYS

SEQ ID NO: 24258 - protein, 24 aa, Homo sapiens
  Native (NRAS Q61L)
QVVIDGETCLLDILDTAGLEEYSA

SEQ ID NO: 24259 - protein, 25 aa, Homo sapiens
  Native (NRAS Q61L)
QVVIDGETCLLDILDTAGLEEYSAM

SEQ ID NO: 24260 - protein, 14 aa, Homo sapiens
  Native (NRAS Q61L)
TCLLDILDTAGLEE

SEQ ID NO: 24261 - protein, 15 aa, Homo sapiens
  Native (NRAS Q61L)
TCLLDILDTAGLEEY

SEQ ID NO: 24262 - protein, 16 aa, Homo sapiens
  Native (NRAS Q61L)
TCLLDILDTAGLEEYS

SEQ ID NO: 24263 - protein, 19 aa, Homo sapiens
  Native (NRAS Q61L)
TCLLDILDTAGLEEYSAMR

SEQ ID NO: 24264 - protein, 20 aa, Homo sapiens
  Native (NRAS Q61L)
TCLLDILDTAGLEEYSAMRD

SEQ ID NO: 24265 - protein, 21 aa, Homo sapiens
  Native (NRAS Q61L)
TCLLDILDTAGLEEYSAMRDQ

SEQ ID NO: 24266 - protein, 22 aa, Homo sapiens
  Native (NRAS Q61L)
TCLLDILDTAGLEEYSAMRDQY

SEQ ID NO: 24267 - protein, 23 aa, Homo sapiens
  Native (NRAS Q61L)
TCLLDILDTAGLEEYSAMRDQYM

SEQ ID NO: 24268 - protein, 19 aa, Homo sapiens
  Native (NRAS Q61L)
VIDGETCLLDILDTAGLEE

SEQ ID NO: 24269 - protein, 20 aa, Homo sapiens
  Native (NRAS Q61L)
VIDGETCLLDILDTAGLEEY

SEQ ID NO: 24270 - protein, 21 aa, Homo sapiens
  Native (NRAS Q61L)
VIDGETCLLDILDTAGLEEYS

SEQ ID NO: 24271 - protein, 22 aa, Homo sapiens
  Native (NRAS Q61L)
VIDGETCLLDILDTAGLEEYSA

SEQ ID NO: 24272 - protein, 23 aa, Homo sapiens
  Native (NRAS Q61L)
VIDGETCLLDILDTAGLEEYSAM

SEQ ID NO: 24273 - protein, 24 aa, Homo sapiens
  Native (NRAS Q61L)
VIDGETCLLDILDTAGLEEYSAMR

SEQ ID NO: 24274 - protein, 20 aa, Homo sapiens
  Native (NRAS Q61L)
VVIDGETCLLDILDTAGLEE

SEQ ID NO: 24275 - protein, 21 aa, Homo sapiens
  Native (NRAS Q61L)
VVIDGETCLLDILDTAGLEEY

SEQ ID NO: 24276 - protein, 22 aa, Homo sapiens
  Native (NRAS Q61L)
VVIDGETCLLDILDTAGLEEYS

SEQ ID NO: 24277 - protein, 23 aa, Homo sapiens
  Native (NRAS Q61L)
VVIDGETCLLDILDTAGLEEYSA

SEQ ID NO: 24278 - protein, 24 aa, Homo sapiens
  Native (NRAS Q61L)
VVIDGETCLLDILDTAGLEEYSAM

SEQ ID NO: 24279 - protein, 25 aa, Homo sapiens
  Native (NRAS Q61L)
VVIDGETCLLDILDTAGLEEYSAMR

SEQ ID NO: 24280 - protein, 15 aa, Homo sapiens
  Native (NRAS Q61R)
CLLDILDTAGREEYS

SEQ ID NO: 24281 - protein, 16 aa, Homo sapiens
  Native (NRAS Q61R)
CLLDILDTAGREEYSA

SEQ ID NO: 24282 - protein, 20 aa, Homo sapiens
  Native (NRAS Q61R)
CLLDILDTAGREEYSAMRDQ

SEQ ID NO: 24283 - protein, 19 aa, Homo sapiens
  Native (NRAS Q61R)
DGETCLLDILDTAGREEYS

SEQ ID NO: 24284 - protein, 20 aa, Homo sapiens
  Native (NRAS Q61R)
DGETCLLDILDTAGREEYSA

SEQ ID NO: 24285 - protein, 21 aa, Homo sapiens
  Native (NRAS Q61R)
DGETCLLDILDTAGREEYSAM

SEQ ID NO: 24286 - protein, 22 aa, Homo sapiens
  Native (NRAS Q61R)
DGETCLLDILDTAGREEYSAMR

SEQ ID NO: 24287 - protein, 23 aa, Homo sapiens
  Native (NRAS Q61R)
DGETCLLDILDTAGREEYSAMRD

SEQ ID NO: 24288 - protein, 24 aa, Homo sapiens
  Native (NRAS Q61R)
DGETCLLDILDTAGREEYSAMRDQ

SEQ ID NO: 24289 - protein, 25 aa, Homo sapiens
  Native (NRAS Q61R)
DGETCLLDILDTAGREEYSAMRDQY

SEQ ID NO: 24290 - protein, 15 aa, Homo sapiens
  Native (NRAS Q61R)
ETCLLDILDTAGREE

SEQ ID NO: 24291 - protein, 16 aa, Homo sapiens
  Native (NRAS Q61R)
ETCLLDILDTAGREEY

SEQ ID NO: 24292 - protein, 17 aa, Homo sapiens
  Native (NRAS Q61R)
ETCLLDILDTAGREEYS

SEQ ID NO: 24293 - protein, 19 aa, Homo sapiens
  Native (NRAS Q61R)
ETCLLDILDTAGREEYSAM

SEQ ID NO: 24294 - protein, 20 aa, Homo sapiens
  Native (NRAS Q61R)
ETCLLDILDTAGREEYSAMR

SEQ ID NO: 24295 - protein, 21 aa, Homo sapiens
  Native (NRAS Q61R)
ETCLLDILDTAGREEYSAMRD

SEQ ID NO: 24296 - protein, 22 aa, Homo sapiens
  Native (NRAS Q61R)
ETCLLDILDTAGREEYSAMRDQ

SEQ ID NO: 24297 - protein, 23 aa, Homo sapiens
  Native (NRAS Q61R)
ETCLLDILDTAGREEYSAMRDQY

SEQ ID NO: 24298 - protein, 24 aa, Homo sapiens
  Native (NRAS Q61R)
ETCLLDILDTAGREEYSAMRDQYM

SEQ ID NO: 24299 - protein, 16 aa, Homo sapiens
  Native (NRAS Q61R)
GETCLLDILDTAGREE

SEQ ID NO: 24300 - protein, 17 aa, Homo sapiens
  Native (NRAS Q61R)
GETCLLDILDTAGREEY

SEQ ID NO: 24301 - protein, 19 aa, Homo sapiens
  Native (NRAS Q61R)
GETCLLDILDTAGREEYSA

SEQ ID NO: 24302 - protein, 20 aa, Homo sapiens
  Native (NRAS Q61R)
GETCLLDILDTAGREEYSAM

SEQ ID NO: 24303 - protein, 21 aa, Homo sapiens
  Native (NRAS Q61R)
GETCLLDILDTAGREEYSAMR

SEQ ID NO: 24304 - protein, 22 aa, Homo sapiens
  Native (NRAS Q61R)
GETCLLDILDTAGREEYSAMRD

SEQ ID NO: 24305 - protein, 23 aa, Homo sapiens
  Native (NRAS Q61R)
GETCLLDILDTAGREEYSAMRDQ

SEQ ID NO: 24306 - protein, 24 aa, Homo sapiens
  Native (NRAS Q61R)
GETCLLDILDTAGREEYSAMRDQY

SEQ ID NO: 24307 - protein, 25 aa, Homo sapiens
  Native (NRAS Q61R)
GETCLLDILDTAGREEYSAMRDQYM

SEQ ID NO: 24308 - protein, 19 aa, Homo sapiens
  Native (NRAS Q61R)
IDGETCLLDILDTAGREEY

SEQ ID NO: 24309 - protein, 20 aa, Homo sapiens
  Native (NRAS Q61R)
IDGETCLLDILDTAGREEYS

SEQ ID NO: 24310 - protein, 21 aa, Homo sapiens
  Native (NRAS Q61R)
IDGETCLLDILDTAGREEYSA

SEQ ID NO: 24311 - protein, 22 aa, Homo sapiens
  Native (NRAS Q61R)
IDGETCLLDILDTAGREEYSAM

SEQ ID NO: 24312 - protein, 23 aa, Homo sapiens
  Native (NRAS Q61R)
IDGETCLLDILDTAGREEYSAMR

SEQ ID NO: 24313 - protein, 24 aa, Homo sapiens
  Native (NRAS Q61R)
IDGETCLLDILDTAGREEYSAMRD

SEQ ID NO: 24314 - protein, 25 aa, Homo sapiens
  Native (NRAS Q61R)
IDGETCLLDILDTAGREEYSAMRDQ

SEQ ID NO: 24315 - protein, 24 aa, Homo sapiens
  Native (NRAS Q61R)
KQVVIDGETCLLDILDTAGREEYS

SEQ ID NO: 24316 - protein, 25 aa, Homo sapiens
  Native (NRAS Q61R)
KQVVIDGETCLLDILDTAGREEYSA

SEQ ID NO: 24317 - protein, 20 aa, Homo sapiens
  Native (NRAS Q61R)
LDILDTAGREEYSAMRDQYM

SEQ ID NO: 24318 - protein, 14 aa, Homo sapiens
  Native (NRAS Q61R)
LLDILDTAGREEYS

SEQ ID NO: 24319 - protein, 15 aa, Homo sapiens
  Native (NRAS Q61R)
LLDILDTAGREEYSA

SEQ ID NO: 24320 - protein, 16 aa, Homo sapiens
  Native (NRAS Q61R)
LLDILDTAGREEYSAM

SEQ ID NO: 24321 - protein, 17 aa, Homo sapiens
  Native (NRAS Q61R)
LLDILDTAGREEYSAMR

SEQ ID NO: 24322 - protein, 22 aa, Homo sapiens
  Native (NRAS Q61R)
QVVIDGETCLLDILDTAGREEY

SEQ ID NO: 24323 - protein, 23 aa, Homo sapiens
  Native (NRAS Q61R)
QVVIDGETCLLDILDTAGREEYS

SEQ ID NO: 24324 - protein, 24 aa, Homo sapiens
  Native (NRAS Q61R)
QVVIDGETCLLDILDTAGREEYSA

SEQ ID NO: 24325 - protein, 25 aa, Homo sapiens
  Native (NRAS Q61R)
QVVIDGETCLLDILDTAGREEYSAM

SEQ ID NO: 24326 - protein, 25 aa, Homo sapiens
  Native (NRAS Q61R)
RKQVVIDGETCLLDILDTAGREEYS

SEQ ID NO: 24327 - protein, 14 aa, Homo sapiens
  Native (NRAS Q61R)
TCLLDILDTAGREE

SEQ ID NO: 24328 - protein, 15 aa, Homo sapiens
  Native (NRAS Q61R)
TCLLDILDTAGREEY

SEQ ID NO: 24329 - protein, 16 aa, Homo sapiens
  Native (NRAS Q61R)
TCLLDILDTAGREEYS

SEQ ID NO: 24330 - protein, 17 aa, Homo sapiens
  Native (NRAS Q61R)
TCLLDILDTAGREEYSA

SEQ ID NO: 24331 - protein, 19 aa, Homo sapiens
  Native (NRAS Q61R)
TCLLDILDTAGREEYSAMR

SEQ ID NO: 24332 - protein, 20 aa, Homo sapiens
  Native (NRAS Q61R)
TCLLDILDTAGREEYSAMRD

SEQ ID NO: 24333 - protein, 21 aa, Homo sapiens
  Native (NRAS Q61R)
TCLLDILDTAGREEYSAMRDQ

SEQ ID NO: 24334 - protein, 23 aa, Homo sapiens
  Native (NRAS Q61R)
TCLLDILDTAGREEYSAMRDQYM

SEQ ID NO: 24335 - protein, 19 aa, Homo sapiens
  Native (NRAS Q61R)
VIDGETCLLDILDTAGREE

SEQ ID NO: 24336 - protein, 20 aa, Homo sapiens
  Native (NRAS Q61R)
VIDGETCLLDILDTAGREEY

SEQ ID NO: 24337 - protein, 21 aa, Homo sapiens
  Native (NRAS Q61R)
VIDGETCLLDILDTAGREEYS

SEQ ID NO: 24338 - protein, 22 aa, Homo sapiens
  Native (NRAS Q61R)
VIDGETCLLDILDTAGREEYSA

SEQ ID NO: 24339 - protein, 23 aa, Homo sapiens
  Native (NRAS Q61R)
VIDGETCLLDILDTAGREEYSAM

SEQ ID NO: 24340 - protein, 24 aa, Homo sapiens
  Native (NRAS Q61R)
VIDGETCLLDILDTAGREEYSAMR

SEQ ID NO: 24341 - protein, 25 aa, Homo sapiens
  Native (NRAS Q61R)
VIDGETCLLDILDTAGREEYSAMRD

SEQ ID NO: 24342 - protein, 20 aa, Homo sapiens
  Native (NRAS Q61R)
VVIDGETCLLDILDTAGREE

SEQ ID NO: 24343 - protein, 21 aa, Homo sapiens
  Native (NRAS Q61R)
VVIDGETCLLDILDTAGREEY

SEQ ID NO: 24344 - protein, 22 aa, Homo sapiens
  Native (NRAS Q61R)
VVIDGETCLLDILDTAGREEYS

SEQ ID NO: 24345 - protein, 23 aa, Homo sapiens
  Native (NRAS Q61R)
VVIDGETCLLDILDTAGREEYSA

SEQ ID NO: 24346 - protein, 24 aa, Homo sapiens
  Native (NRAS Q61R)
VVIDGETCLLDILDTAGREEYSAM

SEQ ID NO: 24347 - protein, 25 aa, Homo sapiens
  Native (NRAS Q61R)
VVIDGETCLLDILDTAGREEYSAMR

SEQ ID NO: 24348 - protein, 24 aa, Homo sapiens
  Native (PIK3CA E542K)
DKEQLKAISTRDPLSKITEQEKDF

SEQ ID NO: 24349 - protein, 25 aa, Homo sapiens
  Native (PIK3CA E542K)
DKEQLKAISTRDPLSKITEQEKDFL

SEQ ID NO: 24350 - protein, 22 aa, Homo sapiens
  Native (PIK3CA E542K)
EQLKAISTRDPLSKITEQEKDF

SEQ ID NO: 24351 - protein, 23 aa, Homo sapiens
  Native (PIK3CA E542K)
EQLKAISTRDPLSKITEQEKDFL

SEQ ID NO: 24352 - protein, 24 aa, Homo sapiens
  Native (PIK3CA E542K)
EQLKAISTRDPLSKITEQEKDFLW

SEQ ID NO: 24353 - protein, 25 aa, Homo sapiens
  Native (PIK3CA E542K)
EQLKAISTRDPLSKITEQEKDFLWS

SEQ ID NO: 24354 - protein, 23 aa, Homo sapiens
  Native (PIK3CA E542K)
KEQLKAISTRDPLSKITEQEKDF

SEQ ID NO: 24355 - protein, 24 aa, Homo sapiens
  Native (PIK3CA E542K)
KEQLKAISTRDPLSKITEQEKDFL

SEQ ID NO: 24356 - protein, 25 aa, Homo sapiens
  Native (PIK3CA E542K)
KEQLKAISTRDPLSKITEQEKDFLW

SEQ ID NO: 24357 - protein, 20 aa, Homo sapiens
  Native (PIK3CA E542K)
QLKAISTRDPLSKITEQEKD

SEQ ID NO: 24358 - protein, 21 aa, Homo sapiens
  Native (PIK3CA E542K)
QLKAISTRDPLSKITEQEKDF

SEQ ID NO: 24359 - protein, 22 aa, Homo sapiens
  Native (PIK3CA E542K)
QLKAISTRDPLSKITEQEKDFL

SEQ ID NO: 24360 - protein, 23 aa, Homo sapiens
  Native (PIK3CA E542K)
QLKAISTRDPLSKITEQEKDFLW

SEQ ID NO: 24361 - protein, 24 aa, Homo sapiens
  Native (PIK3CA E542K)
QLKAISTRDPLSKITEQEKDFLWS

SEQ ID NO: 24362 - protein, 25 aa, Homo sapiens
  Native (PIK3CA E542K)
RDPLSKITEQEKDFLWSHRHYCVTI

SEQ ID NO: 24363 - protein, 20 aa, Homo sapiens
  Native (PIK3CA E545K)
DPLSEITKQEKDFLWSHRHY

SEQ ID NO: 24364 - protein, 21 aa, Homo sapiens
  Native (PIK3CA E545K)
DPLSEITKQEKDFLWSHRHYC

SEQ ID NO: 24365 - protein, 22 aa, Homo sapiens
  Native (PIK3CA E545K)
DPLSEITKQEKDFLWSHRHYCV

SEQ ID NO: 24366 - protein, 23 aa, Homo sapiens
  Native (PIK3CA E545K)
DPLSEITKQEKDFLWSHRHYCVT

SEQ ID NO: 24367 - protein, 24 aa, Homo sapiens
  Native (PIK3CA E545K)
DPLSEITKQEKDFLWSHRHYCVTI

SEQ ID NO: 24368 - protein, 25 aa, Homo sapiens
  Native (PIK3CA E545K)
DPLSEITKQEKDFLWSHRHYCVTIP

SEQ ID NO: 24369 - protein, 15 aa, Homo sapiens
  Native (PIK3CA E545K)
LSEITKQEKDFLWSH

SEQ ID NO: 24370 - protein, 20 aa, Homo sapiens
  Native (PIK3CA E545K)
LSEITKQEKDFLWSHRHYCV

SEQ ID NO: 24371 - protein, 21 aa, Homo sapiens
  Native (PIK3CA E545K)
LSEITKQEKDFLWSHRHYCVT

SEQ ID NO: 24372 - protein, 22 aa, Homo sapiens
  Native (PIK3CA E545K)
LSEITKQEKDFLWSHRHYCVTI

SEQ ID NO: 24373 - protein, 15 aa, Homo sapiens
  Native (PIK3CA E545K)
PLSEITKQEKDFLWS

SEQ ID NO: 24374 - protein, 20 aa, Homo sapiens
  Native (PIK3CA E545K)
PLSEITKQEKDFLWSHRHYC

SEQ ID NO: 24375 - protein, 21 aa, Homo sapiens
  Native (PIK3CA E545K)
PLSEITKQEKDFLWSHRHYCV

SEQ ID NO: 24376 - protein, 22 aa, Homo sapiens
  Native (PIK3CA E545K)
PLSEITKQEKDFLWSHRHYCVT

SEQ ID NO: 24377 - protein, 23 aa, Homo sapiens
  Native (PIK3CA E545K)
PLSEITKQEKDFLWSHRHYCVTI

SEQ ID NO: 24378 - protein, 24 aa, Homo sapiens
  Native (PIK3CA E545K)
PLSEITKQEKDFLWSHRHYCVTIP

SEQ ID NO: 24379 - protein, 25 aa, Homo sapiens
  Native (PIK3CA E545K)
PLSEITKQEKDFLWSHRHYCVTIPE

SEQ ID NO: 24380 - protein, 21 aa, Homo sapiens
  Native (PIK3CA E545K)
RDPLSEITKQEKDFLWSHRHY

SEQ ID NO: 24381 - protein, 22 aa, Homo sapiens
  Native (PIK3CA E545K)
RDPLSEITKQEKDFLWSHRHYC

SEQ ID NO: 24382 - protein, 23 aa, Homo sapiens
  Native (PIK3CA E545K)
RDPLSEITKQEKDFLWSHRHYCV

SEQ ID NO: 24383 - protein, 24 aa, Homo sapiens
  Native (PIK3CA E545K)
RDPLSEITKQEKDFLWSHRHYCVT

SEQ ID NO: 24384 - protein, 25 aa, Homo sapiens
  Native (PIK3CA E545K)
RDPLSEITKQEKDFLWSHRHYCVTI

SEQ ID NO: 24385 - protein, 19 aa, Homo sapiens
  Native (PIK3CA E545K)
SEITKQEKDFLWSHRHYCV

SEQ ID NO: 24386 - protein, 25 aa, Homo sapiens
  Native (PIK3CA E545K)
STRDPLSEITKQEKDFLWSHRHYCV

SEQ ID NO: 24387 - protein, 24 aa, Homo sapiens
  Native (PIK3CA E545K)
TRDPLSEITKQEKDFLWSHRHYCV

SEQ ID NO: 24388 - protein, 25 aa, Homo sapiens
  Native (PIK3CA E545K)
TRDPLSEITKQEKDFLWSHRHYCVT

SEQ ID NO: 24389 - protein, 23 aa, Homo sapiens
  Native (PIK3CA H1047R)
ALDKTEQEALEYFMKQMNDARHG

SEQ ID NO: 24390 - protein, 24 aa, Homo sapiens
  Native (PIK3CA H1047R)
ALDKTEQEALEYFMKQMNDARHGG

SEQ ID NO: 24391 - protein, 25 aa, Homo sapiens
  Native (PIK3CA H1047R)
ALDKTEQEALEYFMKQMNDARHGGW

SEQ ID NO: 24392 - protein, 14 aa, Homo sapiens
  Native (PIK3CA H1047R)
ALEYFMKQMNDARH

SEQ ID NO: 24393 - protein, 15 aa, Homo sapiens
  Native (PIK3CA H1047R)
ALEYFMKQMNDARHG

SEQ ID NO: 24394 - protein, 16 aa, Homo sapiens
  Native (PIK3CA H1047R)
ALEYFMKQMNDARHGG

SEQ ID NO: 24395 - protein, 17 aa, Homo sapiens
  Native (PIK3CA H1047R)
ALEYFMKQMNDARHGGW

SEQ ID NO: 24396 - protein, 19 aa, Homo sapiens
  Native (PIK3CA H1047R)
ALEYFMKQMNDARHGGWTT

SEQ ID NO: 24397 - protein, 20 aa, Homo sapiens
  Native (PIK3CA H1047R)
ALEYFMKQMNDARHGGWTTK

SEQ ID NO: 24398 - protein, 21 aa, Homo sapiens
  Native (PIK3CA H1047R)
ALEYFMKQMNDARHGGWTTKM

SEQ ID NO: 24399 - protein, 22 aa, Homo sapiens
  Native (PIK3CA H1047R)
ALEYFMKQMNDARHGGWTTKMD

SEQ ID NO: 24400 - protein, 23 aa, Homo sapiens
  Native (PIK3CA H1047R)
ALEYFMKQMNDARHGGWTTKMDW

SEQ ID NO: 24401 - protein, 24 aa, Homo sapiens
  Native (PIK3CA H1047R)
ALEYFMKQMNDARHGGWTTKMDWI

SEQ ID NO: 24402 - protein, 25 aa, Homo sapiens
  Native (PIK3CA H1047R)
ALEYFMKQMNDARHGGWTTKMDWIF

SEQ ID NO: 24403 - protein, 21 aa, Homo sapiens
  Native (PIK3CA H1047R)
DKTEQEALEYFMKQMNDARHG

SEQ ID NO: 24404 - protein, 22 aa, Homo sapiens
  Native (PIK3CA H1047R)
DKTEQEALEYFMKQMNDARHGG

SEQ ID NO: 24405 - protein, 23 aa, Homo sapiens
  Native (PIK3CA H1047R)
DKTEQEALEYFMKQMNDARHGGW

SEQ ID NO: 24406 - protein, 24 aa, Homo sapiens
  Native (PIK3CA H1047R)
DKTEQEALEYFMKQMNDARHGGWT

SEQ ID NO: 24407 - protein, 25 aa, Homo sapiens
  Native (PIK3CA H1047R)
DKTEQEALEYFMKQMNDARHGGWTT

SEQ ID NO: 24408 - protein, 15 aa, Homo sapiens
  Native (PIK3CA H1047R)
EALEYFMKQMNDARH

SEQ ID NO: 24409 - protein, 16 aa, Homo sapiens
  Native (PIK3CA H1047R)
EALEYFMKQMNDARHG

SEQ ID NO: 24410 - protein, 17 aa, Homo sapiens
  Native (PIK3CA H1047R)
EALEYFMKQMNDARHGG

SEQ ID NO: 24411 - protein, 19 aa, Homo sapiens
  Native (PIK3CA H1047R)
EALEYFMKQMNDARHGGWT

SEQ ID NO: 24412 - protein, 20 aa, Homo sapiens
  Native (PIK3CA H1047R)
EALEYFMKQMNDARHGGWTT

SEQ ID NO: 24413 - protein, 21 aa, Homo sapiens
  Native (PIK3CA H1047R)
EALEYFMKQMNDARHGGWTTK

SEQ ID NO: 24414 - protein, 22 aa, Homo sapiens
  Native (PIK3CA H1047R)
EALEYFMKQMNDARHGGWTTKM

SEQ ID NO: 24415 - protein, 23 aa, Homo sapiens
  Native (PIK3CA H1047R)
EALEYFMKQMNDARHGGWTTKMD

SEQ ID NO: 24416 - protein, 24 aa, Homo sapiens
  Native (PIK3CA H1047R)
EALEYFMKQMNDARHGGWTTKMDW

SEQ ID NO: 24417 - protein, 25 aa, Homo sapiens
  Native (PIK3CA H1047R)
EALEYFMKQMNDARHGGWTTKMDWI

SEQ ID NO: 24418 - protein, 19 aa, Homo sapiens
  Native (PIK3CA H1047R)
EQEALEYFMKQMNDARHGG

SEQ ID NO: 24419 - protein, 20 aa, Homo sapiens
  Native (PIK3CA H1047R)
EQEALEYFMKQMNDARHGGW

SEQ ID NO: 24420 - protein, 21 aa, Homo sapiens
  Native (PIK3CA H1047R)
EQEALEYFMKQMNDARHGGWT

SEQ ID NO: 24421 - protein, 22 aa, Homo sapiens
  Native (PIK3CA H1047R)
EQEALEYFMKQMNDARHGGWTT

SEQ ID NO: 24422 - protein, 23 aa, Homo sapiens
  Native (PIK3CA H1047R)
EQEALEYFMKQMNDARHGGWTTK

SEQ ID NO: 24423 - protein, 24 aa, Homo sapiens
  Native (PIK3CA H1047R)
EQEALEYFMKQMNDARHGGWTTKM

SEQ ID NO: 24424 - protein, 25 aa, Homo sapiens
  Native (PIK3CA H1047R)
EQEALEYFMKQMNDARHGGWTTKMD

SEQ ID NO: 24425 - protein, 15 aa, Homo sapiens
  Native (PIK3CA H1047R)
EYFMKQMNDARHGGW

SEQ ID NO: 24426 - protein, 17 aa, Homo sapiens
  Native (PIK3CA H1047R)
EYFMKQMNDARHGGWTT

SEQ ID NO: 24427 - protein, 20 aa, Homo sapiens
  Native (PIK3CA H1047R)
EYFMKQMNDARHGGWTTKMD

SEQ ID NO: 24428 - protein, 24 aa, Homo sapiens
  Native (PIK3CA H1047R)
EYFMKQMNDARHGGWTTKMDWIFH

SEQ ID NO: 24429 - protein, 25 aa, Homo sapiens
  Native (PIK3CA H1047R)
EYFMKQMNDARHGGWTTKMDWIFHT

SEQ ID NO: 24430 - protein, 20 aa, Homo sapiens
  Native (PIK3CA H1047R)
KTEQEALEYFMKQMNDARHG

SEQ ID NO: 24431 - protein, 21 aa, Homo sapiens
  Native (PIK3CA H1047R)
KTEQEALEYFMKQMNDARHGG

SEQ ID NO: 24432 - protein, 22 aa, Homo sapiens
  Native (PIK3CA H1047R)
KTEQEALEYFMKQMNDARHGGW

SEQ ID NO: 24433 - protein, 23 aa, Homo sapiens
  Native (PIK3CA H1047R)
KTEQEALEYFMKQMNDARHGGWT

SEQ ID NO: 24434 - protein, 24 aa, Homo sapiens
  Native (PIK3CA H1047R)
KTEQEALEYFMKQMNDARHGGWTT

SEQ ID NO: 24435 - protein, 25 aa, Homo sapiens
  Native (PIK3CA H1047R)
KTEQEALEYFMKQMNDARHGGWTTK

SEQ ID NO: 24436 - protein, 24 aa, Homo sapiens
  Native (PIK3CA H1047R)
LALDKTEQEALEYFMKQMNDARHG

SEQ ID NO: 24437 - protein, 25 aa, Homo sapiens
  Native (PIK3CA H1047R)
LALDKTEQEALEYFMKQMNDARHGG

SEQ ID NO: 24438 - protein, 22 aa, Homo sapiens
  Native (PIK3CA H1047R)
LDKTEQEALEYFMKQMNDARHG

SEQ ID NO: 24439 - protein, 23 aa, Homo sapiens
  Native (PIK3CA H1047R)
LDKTEQEALEYFMKQMNDARHGG

SEQ ID NO: 24440 - protein, 24 aa, Homo sapiens
  Native (PIK3CA H1047R)
LDKTEQEALEYFMKQMNDARHGGW

SEQ ID NO: 24441 - protein, 25 aa, Homo sapiens
  Native (PIK3CA H1047R)
LDKTEQEALEYFMKQMNDARHGGWT

SEQ ID NO: 24442 - protein, 14 aa, Homo sapiens
  Native (PIK3CA H1047R)
LEYFMKQMNDARHG

SEQ ID NO: 24443 - protein, 15 aa, Homo sapiens
  Native (PIK3CA H1047R)
LEYFMKQMNDARHGG

SEQ ID NO: 24444 - protein, 16 aa, Homo sapiens
  Native (PIK3CA H1047R)
LEYFMKQMNDARHGGW

SEQ ID NO: 24445 - protein, 17 aa, Homo sapiens
  Native (PIK3CA H1047R)
LEYFMKQMNDARHGGWT

SEQ ID NO: 24446 - protein, 19 aa, Homo sapiens
  Native (PIK3CA H1047R)
LEYFMKQMNDARHGGWTTK

SEQ ID NO: 24447 - protein, 20 aa, Homo sapiens
  Native (PIK3CA H1047R)
LEYFMKQMNDARHGGWTTKM

SEQ ID NO: 24448 - protein, 21 aa, Homo sapiens
  Native (PIK3CA H1047R)
LEYFMKQMNDARHGGWTTKMD

SEQ ID NO: 24449 - protein, 22 aa, Homo sapiens
  Native (PIK3CA H1047R)
LEYFMKQMNDARHGGWTTKMDW

SEQ ID NO: 24450 - protein, 23 aa, Homo sapiens
  Native (PIK3CA H1047R)
LEYFMKQMNDARHGGWTTKMDWI

SEQ ID NO: 24451 - protein, 24 aa, Homo sapiens
  Native (PIK3CA H1047R)
LEYFMKQMNDARHGGWTTKMDWIF

SEQ ID NO: 24452 - protein, 25 aa, Homo sapiens
  Native (PIK3CA H1047R)
LEYFMKQMNDARHGGWTTKMDWIFH

SEQ ID NO: 24453 - protein, 16 aa, Homo sapiens
  Native (PIK3CA H1047R)
QEALEYFMKQMNDARH

SEQ ID NO: 24454 - protein, 17 aa, Homo sapiens
  Native (PIK3CA H1047R)
QEALEYFMKQMNDARHG

SEQ ID NO: 24455 - protein, 18 aa, Homo sapiens
  Native (PIK3CA H1047R)
QEALEYFMKQMNDARHGG

SEQ ID NO: 24456 - protein, 19 aa, Homo sapiens
  Native (PIK3CA H1047R)
QEALEYFMKQMNDARHGGW

SEQ ID NO: 24457 - protein, 20 aa, Homo sapiens
  Native (PIK3CA H1047R)
QEALEYFMKQMNDARHGGWT

SEQ ID NO: 24458 - protein, 21 aa, Homo sapiens
  Native (PIK3CA H1047R)
QEALEYFMKQMNDARHGGWTT

SEQ ID NO: 24459 - protein, 22 aa, Homo sapiens
  Native (PIK3CA H1047R)
QEALEYFMKQMNDARHGGWTTK

SEQ ID NO: 24460 - protein, 23 aa, Homo sapiens
  Native (PIK3CA H1047R)
QEALEYFMKQMNDARHGGWTTKM

SEQ ID NO: 24461 - protein, 24 aa, Homo sapiens
  Native (PIK3CA H1047R)
QEALEYFMKQMNDARHGGWTTKMD

SEQ ID NO: 24462 - protein, 25 aa, Homo sapiens
  Native (PIK3CA H1047R)
QEALEYFMKQMNDARHGGWTTKMDW

SEQ ID NO: 24463 - protein, 19 aa, Homo sapiens
  Native (PIK3CA H1047R)
TEQEALEYFMKQMNDARHG

SEQ ID NO: 24464 - protein, 20 aa, Homo sapiens
  Native (PIK3CA H1047R)
TEQEALEYFMKQMNDARHGG

SEQ ID NO: 24465 - protein, 21 aa, Homo sapiens
  Native (PIK3CA H1047R)
TEQEALEYFMKQMNDARHGGW

SEQ ID NO: 24466 - protein, 22 aa, Homo sapiens
  Native (PIK3CA H1047R)
TEQEALEYFMKQMNDARHGGWT

SEQ ID NO: 24467 - protein, 23 aa, Homo sapiens
  Native (PIK3CA H1047R)
TEQEALEYFMKQMNDARHGGWTT

SEQ ID NO: 24468 - protein, 24 aa, Homo sapiens
  Native (PIK3CA H1047R)
TEQEALEYFMKQMNDARHGGWTTK

SEQ ID NO: 24469 - protein, 25 aa, Homo sapiens
  Native (PIK3CA H1047R)
TEQEALEYFMKQMNDARHGGWTTKM

SEQ ID NO: 24470 - protein, 25 aa, Homo sapiens
  Native (PIK3CA H1047R)
TLALDKTEQEALEYFMKQMNDARHG

SEQ ID NO: 24471 - protein, 15 aa, Homo sapiens
  Native (PIK3CA H1047R)
YFMKQMNDARHGGWT

SEQ ID NO: 24472 - protein, 24 aa, Homo sapiens
  Native (PIK3CA H1047R)
YFMKQMNDARHGGWTTKMDWIFHT

SEQ ID NO: 24473 - protein, 17 aa, Homo sapiens
  Native (PIK3CA R88Q)
AEREEFFDETRQLCDLR

SEQ ID NO: 24474 - protein, 19 aa, Homo sapiens
  Native (PIK3CA R88Q)
AEREEFFDETRQLCDLRLF

SEQ ID NO: 24475 - protein, 20 aa, Homo sapiens
  Native (PIK3CA R88Q)
AEREEFFDETRQLCDLRLFQ

SEQ ID NO: 24476 - protein, 21 aa, Homo sapiens
  Native (PIK3CA R88Q)
AEREEFFDETRQLCDLRLFQP

SEQ ID NO: 24477 - protein, 22 aa, Homo sapiens
  Native (PIK3CA R88Q)
AEREEFFDETRQLCDLRLFQPF

SEQ ID NO: 24478 - protein, 23 aa, Homo sapiens
  Native (PIK3CA R88Q)
AEREEFFDETRQLCDLRLFQPFL

SEQ ID NO: 24479 - protein, 24 aa, Homo sapiens
  Native (PIK3CA R88Q)
AEREEFFDETRQLCDLRLFQPFLK

SEQ ID NO: 24480 - protein, 25 aa, Homo sapiens
  Native (PIK3CA R88Q)
AEREEFFDETRQLCDLRLFQPFLKV

SEQ ID NO: 24481 - protein, 15 aa, Homo sapiens
  Native (PIK3CA R88Q)
DETRQLCDLRLFQPF

SEQ ID NO: 24482 - protein, 16 aa, Homo sapiens
  Native (PIK3CA R88Q)
DETRQLCDLRLFQPFL

SEQ ID NO: 24483 - protein, 17 aa, Homo sapiens
  Native (PIK3CA R88Q)
DETRQLCDLRLFQPFLK

SEQ ID NO: 24484 - protein, 18 aa, Homo sapiens
  Native (PIK3CA R88Q)
DETRQLCDLRLFQPFLKV

SEQ ID NO: 24485 - protein, 19 aa, Homo sapiens
  Native (PIK3CA R88Q)
DETRQLCDLRLFQPFLKVI

SEQ ID NO: 24486 - protein, 19 aa, Homo sapiens
  Native (PIK3CA R88Q)
EAEREEFFDETRQLCDLRL

SEQ ID NO: 24487 - protein, 20 aa, Homo sapiens
  Native (PIK3CA R88Q)
EAEREEFFDETRQLCDLRLF

SEQ ID NO: 24488 - protein, 21 aa, Homo sapiens
  Native (PIK3CA R88Q)
EAEREEFFDETRQLCDLRLFQ

SEQ ID NO: 24489 - protein, 22 aa, Homo sapiens
  Native (PIK3CA R88Q)
EAEREEFFDETRQLCDLRLFQP

SEQ ID NO: 24490 - protein, 23 aa, Homo sapiens
  Native (PIK3CA R88Q)
EAEREEFFDETRQLCDLRLFQPF

SEQ ID NO: 24491 - protein, 24 aa, Homo sapiens
  Native (PIK3CA R88Q)
EAEREEFFDETRQLCDLRLFQPFL

SEQ ID NO: 24492 - protein, 25 aa, Homo sapiens
  Native (PIK3CA R88Q)
EAEREEFFDETRQLCDLRLFQPFLK

SEQ ID NO: 24493 - protein, 15 aa, Homo sapiens
  Native (PIK3CA R88Q)
EEFFDETRQLCDLRL

SEQ ID NO: 24494 - protein, 16 aa, Homo sapiens
  Native (PIK3CA R88Q)
EEFFDETRQLCDLRLF

SEQ ID NO: 24495 - protein, 17 aa, Homo sapiens
  Native (PIK3CA R88Q)
EEFFDETRQLCDLRLFQ

SEQ ID NO: 24496 - protein, 19 aa, Homo sapiens
  Native (PIK3CA R88Q)
EEFFDETRQLCDLRLFQPF

SEQ ID NO: 24497 - protein, 20 aa, Homo sapiens
  Native (PIK3CA R88Q)
EEFFDETRQLCDLRLFQPFL

SEQ ID NO: 24498 - protein, 21 aa, Homo sapiens
  Native (PIK3CA R88Q)
EEFFDETRQLCDLRLFQPFLK

SEQ ID NO: 24499 - protein, 22 aa, Homo sapiens
  Native (PIK3CA R88Q)
EEFFDETRQLCDLRLFQPFLKV

SEQ ID NO: 24500 - protein, 23 aa, Homo sapiens
  Native (PIK3CA R88Q)
EEFFDETRQLCDLRLFQPFLKVI

SEQ ID NO: 24501 - protein, 24 aa, Homo sapiens
  Native (PIK3CA R88Q)
EEFFDETRQLCDLRLFQPFLKVIE

SEQ ID NO: 24502 - protein, 15 aa, Homo sapiens
  Native (PIK3CA R88Q)
EFFDETRQLCDLRLF

SEQ ID NO: 24503 - protein, 16 aa, Homo sapiens
  Native (PIK3CA R88Q)
EFFDETRQLCDLRLFQ

SEQ ID NO: 24504 - protein, 17 aa, Homo sapiens
  Native (PIK3CA R88Q)
EFFDETRQLCDLRLFQP

SEQ ID NO: 24505 - protein, 18 aa, Homo sapiens
  Native (PIK3CA R88Q)
EFFDETRQLCDLRLFQPF

SEQ ID NO: 24506 - protein, 19 aa, Homo sapiens
  Native (PIK3CA R88Q)
EFFDETRQLCDLRLFQPFL

SEQ ID NO: 24507 - protein, 20 aa, Homo sapiens
  Native (PIK3CA R88Q)
EFFDETRQLCDLRLFQPFLK

SEQ ID NO: 24508 - protein, 21 aa, Homo sapiens
  Native (PIK3CA R88Q)
EFFDETRQLCDLRLFQPFLKV

SEQ ID NO: 24509 - protein, 22 aa, Homo sapiens
  Native (PIK3CA R88Q)
EFFDETRQLCDLRLFQPFLKVI

SEQ ID NO: 24510 - protein, 23 aa, Homo sapiens
  Native (PIK3CA R88Q)
EFFDETRQLCDLRLFQPFLKVIE

SEQ ID NO: 24511 - protein, 16 aa, Homo sapiens
  Native (PIK3CA R88Q)
EREEFFDETRQLCDLR

SEQ ID NO: 24512 - protein, 17 aa, Homo sapiens
  Native (PIK3CA R88Q)
EREEFFDETRQLCDLRL

SEQ ID NO: 24513 - protein, 19 aa, Homo sapiens
  Native (PIK3CA R88Q)
EREEFFDETRQLCDLRLFQ

SEQ ID NO: 24514 - protein, 20 aa, Homo sapiens
  Native (PIK3CA R88Q)
EREEFFDETRQLCDLRLFQP

SEQ ID NO: 24515 - protein, 21 aa, Homo sapiens
  Native (PIK3CA R88Q)
EREEFFDETRQLCDLRLFQPF

SEQ ID NO: 24516 - protein, 22 aa, Homo sapiens
  Native (PIK3CA R88Q)
EREEFFDETRQLCDLRLFQPFL

SEQ ID NO: 24517 - protein, 23 aa, Homo sapiens
  Native (PIK3CA R88Q)
EREEFFDETRQLCDLRLFQPFLK

SEQ ID NO: 24518 - protein, 24 aa, Homo sapiens
  Native (PIK3CA R88Q)
EREEFFDETRQLCDLRLFQPFLKV

SEQ ID NO: 24519 - protein, 25 aa, Homo sapiens
  Native (PIK3CA R88Q)
EREEFFDETRQLCDLRLFQPFLKVI

SEQ ID NO: 24520 - protein, 14 aa, Homo sapiens
  Native (PIK3CA R88Q)
ETRQLCDLRLFQPF

SEQ ID NO: 24521 - protein, 15 aa, Homo sapiens
  Native (PIK3CA R88Q)
ETRQLCDLRLFQPFL

SEQ ID NO: 24522 - protein, 16 aa, Homo sapiens
  Native (PIK3CA R88Q)
ETRQLCDLRLFQPFLK

SEQ ID NO: 24523 - protein, 17 aa, Homo sapiens
  Native (PIK3CA R88Q)
ETRQLCDLRLFQPFLKV

SEQ ID NO: 24524 - protein, 14 aa, Homo sapiens
  Native (PIK3CA R88Q)
FDETRQLCDLRLFQ

SEQ ID NO: 24525 - protein, 15 aa, Homo sapiens
  Native (PIK3CA R88Q)
FDETRQLCDLRLFQP

SEQ ID NO: 24526 - protein, 16 aa, Homo sapiens
  Native (PIK3CA R88Q)
FDETRQLCDLRLFQPF

SEQ ID NO: 24527 - protein, 17 aa, Homo sapiens
  Native (PIK3CA R88Q)
FDETRQLCDLRLFQPFL

SEQ ID NO: 24528 - protein, 18 aa, Homo sapiens
  Native (PIK3CA R88Q)
FDETRQLCDLRLFQPFLK

SEQ ID NO: 24529 - protein, 19 aa, Homo sapiens
  Native (PIK3CA R88Q)
FDETRQLCDLRLFQPFLKV

SEQ ID NO: 24530 - protein, 20 aa, Homo sapiens
  Native (PIK3CA R88Q)
FDETRQLCDLRLFQPFLKVI

SEQ ID NO: 24531 - protein, 21 aa, Homo sapiens
  Native (PIK3CA R88Q)
FDETRQLCDLRLFQPFLKVIE

SEQ ID NO: 24532 - protein, 14 aa, Homo sapiens
  Native (PIK3CA R88Q)
FFDETRQLCDLRLF

SEQ ID NO: 24533 - protein, 15 aa, Homo sapiens
  Native (PIK3CA R88Q)
FFDETRQLCDLRLFQ

SEQ ID NO: 24534 - protein, 16 aa, Homo sapiens
  Native (PIK3CA R88Q)
FFDETRQLCDLRLFQP

SEQ ID NO: 24535 - protein, 17 aa, Homo sapiens
  Native (PIK3CA R88Q)
FFDETRQLCDLRLFQPF

SEQ ID NO: 24536 - protein, 18 aa, Homo sapiens
  Native (PIK3CA R88Q)
FFDETRQLCDLRLFQPFL

SEQ ID NO: 24537 - protein, 19 aa, Homo sapiens
  Native (PIK3CA R88Q)
FFDETRQLCDLRLFQPFLK

SEQ ID NO: 24538 - protein, 20 aa, Homo sapiens
  Native (PIK3CA R88Q)
FFDETRQLCDLRLFQPFLKV

SEQ ID NO: 24539 - protein, 21 aa, Homo sapiens
  Native (PIK3CA R88Q)
FFDETRQLCDLRLFQPFLKVI

SEQ ID NO: 24540 - protein, 22 aa, Homo sapiens
  Native (PIK3CA R88Q)
FFDETRQLCDLRLFQPFLKVIE

SEQ ID NO: 24541 - protein, 25 aa, Homo sapiens
  Native (PIK3CA R88Q)
FVSVTQEAEREEFFDETRQLCDLRL

SEQ ID NO: 24542 - protein, 25 aa, Homo sapiens
  Native (PIK3CA R88Q)
IFVSVTQEAEREEFFDETRQLCDLR

SEQ ID NO: 24543 - protein, 20 aa, Homo sapiens
  Native (PIK3CA R88Q)
QEAEREEFFDETRQLCDLRL

SEQ ID NO: 24544 - protein, 21 aa, Homo sapiens
  Native (PIK3CA R88Q)
QEAEREEFFDETRQLCDLRLF

SEQ ID NO: 24545 - protein, 22 aa, Homo sapiens
  Native (PIK3CA R88Q)
QEAEREEFFDETRQLCDLRLFQ

SEQ ID NO: 24546 - protein, 23 aa, Homo sapiens
  Native (PIK3CA R88Q)
QEAEREEFFDETRQLCDLRLFQP

SEQ ID NO: 24547 - protein, 24 aa, Homo sapiens
  Native (PIK3CA R88Q)
QEAEREEFFDETRQLCDLRLFQPF

SEQ ID NO: 24548 - protein, 25 aa, Homo sapiens
  Native (PIK3CA R88Q)
QEAEREEFFDETRQLCDLRLFQPFL

SEQ ID NO: 24549 - protein, 15 aa, Homo sapiens
  Native (PIK3CA R88Q)
REEFFDETRQLCDLR

SEQ ID NO: 24550 - protein, 16 aa, Homo sapiens
  Native (PIK3CA R88Q)
REEFFDETRQLCDLRL

SEQ ID NO: 24551 - protein, 17 aa, Homo sapiens
  Native (PIK3CA R88Q)
REEFFDETRQLCDLRLF

SEQ ID NO: 24552 - protein, 19 aa, Homo sapiens
  Native (PIK3CA R88Q)
REEFFDETRQLCDLRLFQP

SEQ ID NO: 24553 - protein, 20 aa, Homo sapiens
  Native (PIK3CA R88Q)
REEFFDETRQLCDLRLFQPF

SEQ ID NO: 24554 - protein, 21 aa, Homo sapiens
  Native (PIK3CA R88Q)
REEFFDETRQLCDLRLFQPFL

SEQ ID NO: 24555 - protein, 22 aa, Homo sapiens
  Native (PIK3CA R88Q)
REEFFDETRQLCDLRLFQPFLK

SEQ ID NO: 24556 - protein, 23 aa, Homo sapiens
  Native (PIK3CA R88Q)
REEFFDETRQLCDLRLFQPFLKV

SEQ ID NO: 24557 - protein, 24 aa, Homo sapiens
  Native (PIK3CA R88Q)
REEFFDETRQLCDLRLFQPFLKVI

SEQ ID NO: 24558 - protein, 25 aa, Homo sapiens
  Native (PIK3CA R88Q)
REEFFDETRQLCDLRLFQPFLKVIE

SEQ ID NO: 24559 - protein, 24 aa, Homo sapiens
  Native (PIK3CA R88Q)
SVTQEAEREEFFDETRQLCDLRLF

SEQ ID NO: 24560 - protein, 25 aa, Homo sapiens
  Native (PIK3CA R88Q)
SVTQEAEREEFFDETRQLCDLRLFQ

SEQ ID NO: 24561 - protein, 20 aa, Homo sapiens
  Native (PIK3CA R88Q)
TQEAEREEFFDETRQLCDLR

SEQ ID NO: 24562 - protein, 22 aa, Homo sapiens
  Native (PIK3CA R88Q)
TQEAEREEFFDETRQLCDLRLF

SEQ ID NO: 24563 - protein, 23 aa, Homo sapiens
  Native (PIK3CA R88Q)
TQEAEREEFFDETRQLCDLRLFQ

SEQ ID NO: 24564 - protein, 24 aa, Homo sapiens
  Native (PIK3CA R88Q)
TQEAEREEFFDETRQLCDLRLFQP

SEQ ID NO: 24565 - protein, 25 aa, Homo sapiens
  Native (PIK3CA R88Q)
TQEAEREEFFDETRQLCDLRLFQPF

SEQ ID NO: 24566 - protein, 13 aa, Homo sapiens
  Native (PIK3CA R88Q)
TRQLCDLRLFQPF

SEQ ID NO: 24567 - protein, 14 aa, Homo sapiens
  Native (PIK3CA R88Q)
TRQLCDLRLFQPFL

SEQ ID NO: 24568 - protein, 25 aa, Homo sapiens
  Native (PIK3CA R88Q)
VSVTQEAEREEFFDETRQLCDLRLF

SEQ ID NO: 24569 - protein, 23 aa, Homo sapiens
  Native (PIK3CA R88Q)
VTQEAEREEFFDETRQLCDLRLF

SEQ ID NO: 24570 - protein, 24 aa, Homo sapiens
  Native (PIK3CA R88Q)
VTQEAEREEFFDETRQLCDLRLFQ

SEQ ID NO: 24571 - protein, 25 aa, Homo sapiens
  Native (PIK3CA R88Q)
VTQEAEREEFFDETRQLCDLRLFQP

SEQ ID NO: 24572 - protein, 16 aa, Homo sapiens
  Native (PTEN R130G)
AAIHCKAGKGGTGVMI

SEQ ID NO: 24573 - protein, 17 aa, Homo sapiens
  Native (PTEN R130G)
AAIHCKAGKGGTGVMIC

SEQ ID NO: 24574 - protein, 19 aa, Homo sapiens
  Native (PTEN R130G)
AAIHCKAGKGGTGVMICAY

SEQ ID NO: 24575 - protein, 20 aa, Homo sapiens
  Native (PTEN R130G)
AAIHCKAGKGGTGVMICAYL

SEQ ID NO: 24576 - protein, 21 aa, Homo sapiens
  Native (PTEN R130G)
AAIHCKAGKGGTGVMICAYLL

SEQ ID NO: 24577 - protein, 22 aa, Homo sapiens
  Native (PTEN R130G)
AAIHCKAGKGGTGVMICAYLLH

SEQ ID NO: 24578 - protein, 23 aa, Homo sapiens
  Native (PTEN R130G)
AAIHCKAGKGGTGVMICAYLLHR

SEQ ID NO: 24579 - protein, 24 aa, Homo sapiens
  Native (PTEN R130G)
AAIHCKAGKGGTGVMICAYLLHRG

SEQ ID NO: 24580 - protein, 25 aa, Homo sapiens
  Native (PTEN R130G)
AAIHCKAGKGGTGVMICAYLLHRGK

SEQ ID NO: 24581 - protein, 14 aa, Homo sapiens
  Native (PTEN R130G)
AGKGGTGVMICAYL

SEQ ID NO: 24582 - protein, 15 aa, Homo sapiens
  Native (PTEN R130G)
AGKGGTGVMICAYLL

SEQ ID NO: 24583 - protein, 16 aa, Homo sapiens
  Native (PTEN R130G)
AGKGGTGVMICAYLLH

SEQ ID NO: 24584 - protein, 17 aa, Homo sapiens
  Native (PTEN R130G)
AGKGGTGVMICAYLLHR

SEQ ID NO: 24585 - protein, 18 aa, Homo sapiens
  Native (PTEN R130G)
AGKGGTGVMICAYLLHRG

SEQ ID NO: 24586 - protein, 19 aa, Homo sapiens
  Native (PTEN R130G)
AGKGGTGVMICAYLLHRGK

SEQ ID NO: 24587 - protein, 15 aa, Homo sapiens
  Native (PTEN R130G)
AIHCKAGKGGTGVMI

SEQ ID NO: 24588 - protein, 16 aa, Homo sapiens
  Native (PTEN R130G)
AIHCKAGKGGTGVMIC

SEQ ID NO: 24589 - protein, 17 aa, Homo sapiens
  Native (PTEN R130G)
AIHCKAGKGGTGVMICA

SEQ ID NO: 24590 - protein, 18 aa, Homo sapiens
  Native (PTEN R130G)
AIHCKAGKGGTGVMICAY

SEQ ID NO: 24591 - protein, 19 aa, Homo sapiens
  Native (PTEN R130G)
AIHCKAGKGGTGVMICAYL

SEQ ID NO: 24592 - protein, 20 aa, Homo sapiens
  Native (PTEN R130G)
AIHCKAGKGGTGVMICAYLL

SEQ ID NO: 24593 - protein, 21 aa, Homo sapiens
  Native (PTEN R130G)
AIHCKAGKGGTGVMICAYLLH

SEQ ID NO: 24594 - protein, 22 aa, Homo sapiens
  Native (PTEN R130G)
AIHCKAGKGGTGVMICAYLLHR

SEQ ID NO: 24595 - protein, 23 aa, Homo sapiens
  Native (PTEN R130G)
AIHCKAGKGGTGVMICAYLLHRG

SEQ ID NO: 24596 - protein, 24 aa, Homo sapiens
  Native (PTEN R130G)
AIHCKAGKGGTGVMICAYLLHRGK

SEQ ID NO: 24597 - protein, 25 aa, Homo sapiens
  Native (PTEN R130G)
AIHCKAGKGGTGVMICAYLLHRGKF

SEQ ID NO: 24598 - protein, 14 aa, Homo sapiens
  Native (PTEN R130G)
CKAGKGGTGVMICA

SEQ ID NO: 24599 - protein, 15 aa, Homo sapiens
  Native (PTEN R130G)
CKAGKGGTGVMICAY

SEQ ID NO: 24600 - protein, 16 aa, Homo sapiens
  Native (PTEN R130G)
CKAGKGGTGVMICAYL

SEQ ID NO: 24601 - protein, 17 aa, Homo sapiens
  Native (PTEN R130G)
CKAGKGGTGVMICAYLL

SEQ ID NO: 24602 - protein, 18 aa, Homo sapiens
  Native (PTEN R130G)
CKAGKGGTGVMICAYLLH

SEQ ID NO: 24603 - protein, 19 aa, Homo sapiens
  Native (PTEN R130G)
CKAGKGGTGVMICAYLLHR

SEQ ID NO: 24604 - protein, 20 aa, Homo sapiens
  Native (PTEN R130G)
CKAGKGGTGVMICAYLLHRG

SEQ ID NO: 24605 - protein, 21 aa, Homo sapiens
  Native (PTEN R130G)
CKAGKGGTGVMICAYLLHRGK

SEQ ID NO: 24606 - protein, 22 aa, Homo sapiens
  Native (PTEN R130G)
CKAGKGGTGVMICAYLLHRGKF

SEQ ID NO: 24607 - protein, 23 aa, Homo sapiens
  Native (PTEN R130G)
CKAGKGGTGVMICAYLLHRGKFL

SEQ ID NO: 24608 - protein, 24 aa, Homo sapiens
  Native (PTEN R130G)
CKAGKGGTGVMICAYLLHRGKFLK

SEQ ID NO: 24609 - protein, 25 aa, Homo sapiens
  Native (PTEN R130G)
CKAGKGGTGVMICAYLLHRGKFLKA

SEQ ID NO: 24610 - protein, 14 aa, Homo sapiens
  Native (PTEN R130G)
HCKAGKGGTGVMIC

SEQ ID NO: 24611 - protein, 15 aa, Homo sapiens
  Native (PTEN R130G)
HCKAGKGGTGVMICA

SEQ ID NO: 24612 - protein, 16 aa, Homo sapiens
  Native (PTEN R130G)
HCKAGKGGTGVMICAY

SEQ ID NO: 24613 - protein, 17 aa, Homo sapiens
  Native (PTEN R130G)
HCKAGKGGTGVMICAYL

SEQ ID NO: 24614 - protein, 18 aa, Homo sapiens
  Native (PTEN R130G)
HCKAGKGGTGVMICAYLL

SEQ ID NO: 24615 - protein, 19 aa, Homo sapiens
  Native (PTEN R130G)
HCKAGKGGTGVMICAYLLH

SEQ ID NO: 24616 - protein, 20 aa, Homo sapiens
  Native (PTEN R130G)
HCKAGKGGTGVMICAYLLHR

SEQ ID NO: 24617 - protein, 21 aa, Homo sapiens
  Native (PTEN R130G)
HCKAGKGGTGVMICAYLLHRG

SEQ ID NO: 24618 - protein, 22 aa, Homo sapiens
  Native (PTEN R130G)
HCKAGKGGTGVMICAYLLHRGK

SEQ ID NO: 24619 - protein, 23 aa, Homo sapiens
  Native (PTEN R130G)
HCKAGKGGTGVMICAYLLHRGKF

SEQ ID NO: 24620 - protein, 24 aa, Homo sapiens
  Native (PTEN R130G)
HCKAGKGGTGVMICAYLLHRGKFL

SEQ ID NO: 24621 - protein, 25 aa, Homo sapiens
  Native (PTEN R130G)
HCKAGKGGTGVMICAYLLHRGKFLK

SEQ ID NO: 24622 - protein, 20 aa, Homo sapiens
  Native (PTEN R130G)
HVAAIHCKAGKGGTGVMICA

SEQ ID NO: 24623 - protein, 22 aa, Homo sapiens
  Native (PTEN R130G)
HVAAIHCKAGKGGTGVMICAYL

SEQ ID NO: 24624 - protein, 23 aa, Homo sapiens
  Native (PTEN R130G)
HVAAIHCKAGKGGTGVMICAYLL

SEQ ID NO: 24625 - protein, 24 aa, Homo sapiens
  Native (PTEN R130G)
HVAAIHCKAGKGGTGVMICAYLLH

SEQ ID NO: 24626 - protein, 25 aa, Homo sapiens
  Native (PTEN R130G)
HVAAIHCKAGKGGTGVMICAYLLHR

SEQ ID NO: 24627 - protein, 14 aa, Homo sapiens
  Native (PTEN R130G)
IHCKAGKGGTGVMI

SEQ ID NO: 24628 - protein, 15 aa, Homo sapiens
  Native (PTEN R130G)
IHCKAGKGGTGVMIC

SEQ ID NO: 24629 - protein, 16 aa, Homo sapiens
  Native (PTEN R130G)
IHCKAGKGGTGVMICA

SEQ ID NO: 24630 - protein, 17 aa, Homo sapiens
  Native (PTEN R130G)
IHCKAGKGGTGVMICAY

SEQ ID NO: 24631 - protein, 18 aa, Homo sapiens
  Native (PTEN R130G)
IHCKAGKGGTGVMICAYL

SEQ ID NO: 24632 - protein, 19 aa, Homo sapiens
  Native (PTEN R130G)
IHCKAGKGGTGVMICAYLL

SEQ ID NO: 24633 - protein, 20 aa, Homo sapiens
  Native (PTEN R130G)
IHCKAGKGGTGVMICAYLLH

SEQ ID NO: 24634 - protein, 21 aa, Homo sapiens
  Native (PTEN R130G)
IHCKAGKGGTGVMICAYLLHR

SEQ ID NO: 24635 - protein, 22 aa, Homo sapiens
  Native (PTEN R130G)
IHCKAGKGGTGVMICAYLLHRG

SEQ ID NO: 24636 - protein, 23 aa, Homo sapiens
  Native (PTEN R130G)
IHCKAGKGGTGVMICAYLLHRGK

SEQ ID NO: 24637 - protein, 24 aa, Homo sapiens
  Native (PTEN R130G)
IHCKAGKGGTGVMICAYLLHRGKF

SEQ ID NO: 24638 - protein, 25 aa, Homo sapiens
  Native (PTEN R130G)
IHCKAGKGGTGVMICAYLLHRGKFL

SEQ ID NO: 24639 - protein, 14 aa, Homo sapiens
  Native (PTEN R130G)
KAGKGGTGVMICAY

SEQ ID NO: 24640 - protein, 15 aa, Homo sapiens
  Native (PTEN R130G)
KAGKGGTGVMICAYL

SEQ ID NO: 24641 - protein, 16 aa, Homo sapiens
  Native (PTEN R130G)
KAGKGGTGVMICAYLL

SEQ ID NO: 24642 - protein, 17 aa, Homo sapiens
  Native (PTEN R130G)
KAGKGGTGVMICAYLLH

SEQ ID NO: 24643 - protein, 18 aa, Homo sapiens
  Native (PTEN R130G)
KAGKGGTGVMICAYLLHR

SEQ ID NO: 24644 - protein, 19 aa, Homo sapiens
  Native (PTEN R130G)
KAGKGGTGVMICAYLLHRG

SEQ ID NO: 24645 - protein, 20 aa, Homo sapiens
  Native (PTEN R130G)
KAGKGGTGVMICAYLLHRGK

SEQ ID NO: 24646 - protein, 21 aa, Homo sapiens
  Native (PTEN R130G)
KAGKGGTGVMICAYLLHRGKF

SEQ ID NO: 24647 - protein, 22 aa, Homo sapiens
  Native (PTEN R130G)
KAGKGGTGVMICAYLLHRGKFL

SEQ ID NO: 24648 - protein, 23 aa, Homo sapiens
  Native (PTEN R130G)
KAGKGGTGVMICAYLLHRGKFLK

SEQ ID NO: 24649 - protein, 24 aa, Homo sapiens
  Native (PTEN R130G)
KAGKGGTGVMICAYLLHRGKFLKA

SEQ ID NO: 24650 - protein, 25 aa, Homo sapiens
  Native (PTEN R130G)
KAGKGGTGVMICAYLLHRGKFLKAQ

SEQ ID NO: 24651 - protein, 25 aa, Homo sapiens
  Native (PTEN R130G)
NHVAAIHCKAGKGGTGVMICAYLLH

SEQ ID NO: 24652 - protein, 19 aa, Homo sapiens
  Native (PTEN R130G)
VAAIHCKAGKGGTGVMICA

SEQ ID NO: 24653 - protein, 20 aa, Homo sapiens
  Native (PTEN R130G)
VAAIHCKAGKGGTGVMICAY

SEQ ID NO: 24654 - protein, 21 aa, Homo sapiens
  Native (PTEN R130G)
VAAIHCKAGKGGTGVMICAYL

SEQ ID NO: 24655 - protein, 22 aa, Homo sapiens
  Native (PTEN R130G)
VAAIHCKAGKGGTGVMICAYLL

SEQ ID NO: 24656 - protein, 23 aa, Homo sapiens
  Native (PTEN R130G)
VAAIHCKAGKGGTGVMICAYLLH

SEQ ID NO: 24657 - protein, 24 aa, Homo sapiens
  Native (PTEN R130G)
VAAIHCKAGKGGTGVMICAYLLHR

SEQ ID NO: 24658 - protein, 25 aa, Homo sapiens
  Native (PTEN R130G)
VAAIHCKAGKGGTGVMICAYLLHRG

SEQ ID NO: 24659 - protein, 15 aa, Homo sapiens
  Native (PTEN R130Q)
AAIHCKAGKGQTGVM

SEQ ID NO: 24660 - protein, 16 aa, Homo sapiens
  Native (PTEN R130Q)
AAIHCKAGKGQTGVMI

SEQ ID NO: 24661 - protein, 17 aa, Homo sapiens
  Native (PTEN R130Q)
AAIHCKAGKGQTGVMIC

SEQ ID NO: 24662 - protein, 19 aa, Homo sapiens
  Native (PTEN R130Q)
AAIHCKAGKGQTGVMICAY

SEQ ID NO: 24663 - protein, 20 aa, Homo sapiens
  Native (PTEN R130Q)
AAIHCKAGKGQTGVMICAYL

SEQ ID NO: 24664 - protein, 21 aa, Homo sapiens
  Native (PTEN R130Q)
AAIHCKAGKGQTGVMICAYLL

SEQ ID NO: 24665 - protein, 22 aa, Homo sapiens
  Native (PTEN R130Q)
AAIHCKAGKGQTGVMICAYLLH

SEQ ID NO: 24666 - protein, 23 aa, Homo sapiens
  Native (PTEN R130Q)
AAIHCKAGKGQTGVMICAYLLHR

SEQ ID NO: 24667 - protein, 24 aa, Homo sapiens
  Native (PTEN R130Q)
AAIHCKAGKGQTGVMICAYLLHRG

SEQ ID NO: 24668 - protein, 25 aa, Homo sapiens
  Native (PTEN R130Q)
AAIHCKAGKGQTGVMICAYLLHRGK

SEQ ID NO: 24669 - protein, 15 aa, Homo sapiens
  Native (PTEN R130Q)
AGKGQTGVMICAYLL

SEQ ID NO: 24670 - protein, 14 aa, Homo sapiens
  Native (PTEN R130Q)
AIHCKAGKGQTGVM

SEQ ID NO: 24671 - protein, 15 aa, Homo sapiens
  Native (PTEN R130Q)
AIHCKAGKGQTGVMI

SEQ ID NO: 24672 - protein, 16 aa, Homo sapiens
  Native (PTEN R130Q)
AIHCKAGKGQTGVMIC

SEQ ID NO: 24673 - protein, 17 aa, Homo sapiens
  Native (PTEN R130Q)
AIHCKAGKGQTGVMICA

SEQ ID NO: 24674 - protein, 18 aa, Homo sapiens
  Native (PTEN R130Q)
AIHCKAGKGQTGVMICAY

SEQ ID NO: 24675 - protein, 19 aa, Homo sapiens
  Native (PTEN R130Q)
AIHCKAGKGQTGVMICAYL

SEQ ID NO: 24676 - protein, 20 aa, Homo sapiens
  Native (PTEN R130Q)
AIHCKAGKGQTGVMICAYLL

SEQ ID NO: 24677 - protein, 21 aa, Homo sapiens
  Native (PTEN R130Q)
AIHCKAGKGQTGVMICAYLLH

SEQ ID NO: 24678 - protein, 22 aa, Homo sapiens
  Native (PTEN R130Q)
AIHCKAGKGQTGVMICAYLLHR

SEQ ID NO: 24679 - protein, 23 aa, Homo sapiens
  Native (PTEN R130Q)
AIHCKAGKGQTGVMICAYLLHRG

SEQ ID NO: 24680 - protein, 24 aa, Homo sapiens
  Native (PTEN R130Q)
AIHCKAGKGQTGVMICAYLLHRGK

SEQ ID NO: 24681 - protein, 25 aa, Homo sapiens
  Native (PTEN R130Q)
AIHCKAGKGQTGVMICAYLLHRGKF

SEQ ID NO: 24682 - protein, 14 aa, Homo sapiens
  Native (PTEN R130Q)
CKAGKGQTGVMICA

SEQ ID NO: 24683 - protein, 15 aa, Homo sapiens
  Native (PTEN R130Q)
CKAGKGQTGVMICAY

SEQ ID NO: 24684 - protein, 16 aa, Homo sapiens
  Native (PTEN R130Q)
CKAGKGQTGVMICAYL

SEQ ID NO: 24685 - protein, 15 aa, Homo sapiens
  Native (PTEN R130Q)
HCKAGKGQTGVMICA

SEQ ID NO: 24686 - protein, 16 aa, Homo sapiens
  Native (PTEN R130Q)
HCKAGKGQTGVMICAY

SEQ ID NO: 24687 - protein, 17 aa, Homo sapiens
  Native (PTEN R130Q)
HCKAGKGQTGVMICAYL

SEQ ID NO: 24688 - protein, 16 aa, Homo sapiens
  Native (PTEN R130Q)
HVAAIHCKAGKGQTGV

SEQ ID NO: 24689 - protein, 17 aa, Homo sapiens
  Native (PTEN R130Q)
HVAAIHCKAGKGQTGVM

SEQ ID NO: 24690 - protein, 19 aa, Homo sapiens
  Native (PTEN R130Q)
HVAAIHCKAGKGQTGVMIC

SEQ ID NO: 24691 - protein, 20 aa, Homo sapiens
  Native (PTEN R130Q)
HVAAIHCKAGKGQTGVMICA

SEQ ID NO: 24692 - protein, 21 aa, Homo sapiens
  Native (PTEN R130Q)
HVAAIHCKAGKGQTGVMICAY

SEQ ID NO: 24693 - protein, 22 aa, Homo sapiens
  Native (PTEN R130Q)
HVAAIHCKAGKGQTGVMICAYL

SEQ ID NO: 24694 - protein, 23 aa, Homo sapiens
  Native (PTEN R130Q)
HVAAIHCKAGKGQTGVMICAYLL

SEQ ID NO: 24695 - protein, 24 aa, Homo sapiens
  Native (PTEN R130Q)
HVAAIHCKAGKGQTGVMICAYLLH

SEQ ID NO: 24696 - protein, 25 aa, Homo sapiens
  Native (PTEN R130Q)
HVAAIHCKAGKGQTGVMICAYLLHR

SEQ ID NO: 24697 - protein, 14 aa, Homo sapiens
  Native (PTEN R130Q)
IHCKAGKGQTGVMI

SEQ ID NO: 24698 - protein, 15 aa, Homo sapiens
  Native (PTEN R130Q)
IHCKAGKGQTGVMIC

SEQ ID NO: 24699 - protein, 16 aa, Homo sapiens
  Native (PTEN R130Q)
IHCKAGKGQTGVMICA

SEQ ID NO: 24700 - protein, 17 aa, Homo sapiens
  Native (PTEN R130Q)
IHCKAGKGQTGVMICAY

SEQ ID NO: 24701 - protein, 18 aa, Homo sapiens
  Native (PTEN R130Q)
IHCKAGKGQTGVMICAYL

SEQ ID NO: 24702 - protein, 19 aa, Homo sapiens
  Native (PTEN R130Q)
IHCKAGKGQTGVMICAYLL

SEQ ID NO: 24703 - protein, 20 aa, Homo sapiens
  Native (PTEN R130Q)
IHCKAGKGQTGVMICAYLLH

SEQ ID NO: 24704 - protein, 21 aa, Homo sapiens
  Native (PTEN R130Q)
IHCKAGKGQTGVMICAYLLHR

SEQ ID NO: 24705 - protein, 22 aa, Homo sapiens
  Native (PTEN R130Q)
IHCKAGKGQTGVMICAYLLHRG

SEQ ID NO: 24706 - protein, 14 aa, Homo sapiens
  Native (PTEN R130Q)
KAGKGQTGVMICAY

SEQ ID NO: 24707 - protein, 15 aa, Homo sapiens
  Native (PTEN R130Q)
KAGKGQTGVMICAYL

SEQ ID NO: 24708 - protein, 16 aa, Homo sapiens
  Native (PTEN R130Q)
KAGKGQTGVMICAYLL

SEQ ID NO: 24709 - protein, 19 aa, Homo sapiens
  Native (PTEN R130Q)
NHVAAIHCKAGKGQTGVMI

SEQ ID NO: 24710 - protein, 20 aa, Homo sapiens
  Native (PTEN R130Q)
NHVAAIHCKAGKGQTGVMIC

SEQ ID NO: 24711 - protein, 22 aa, Homo sapiens
  Native (PTEN R130Q)
NHVAAIHCKAGKGQTGVMICAY

SEQ ID NO: 24712 - protein, 23 aa, Homo sapiens
  Native (PTEN R130Q)
NHVAAIHCKAGKGQTGVMICAYL

SEQ ID NO: 24713 - protein, 24 aa, Homo sapiens
  Native (PTEN R130Q)
NHVAAIHCKAGKGQTGVMICAYLL

SEQ ID NO: 24714 - protein, 25 aa, Homo sapiens
  Native (PTEN R130Q)
NHVAAIHCKAGKGQTGVMICAYLLH

SEQ ID NO: 24715 - protein, 15 aa, Homo sapiens
  Native (PTEN R130Q)
VAAIHCKAGKGQTGV

SEQ ID NO: 24716 - protein, 16 aa, Homo sapiens
  Native (PTEN R130Q)
VAAIHCKAGKGQTGVM

SEQ ID NO: 24717 - protein, 17 aa, Homo sapiens
  Native (PTEN R130Q)
VAAIHCKAGKGQTGVMI

SEQ ID NO: 24718 - protein, 19 aa, Homo sapiens
  Native (PTEN R130Q)
VAAIHCKAGKGQTGVMICA

SEQ ID NO: 24719 - protein, 20 aa, Homo sapiens
  Native (PTEN R130Q)
VAAIHCKAGKGQTGVMICAY

SEQ ID NO: 24720 - protein, 21 aa, Homo sapiens
  Native (PTEN R130Q)
VAAIHCKAGKGQTGVMICAYL

SEQ ID NO: 24721 - protein, 22 aa, Homo sapiens
  Native (PTEN R130Q)
VAAIHCKAGKGQTGVMICAYLL

SEQ ID NO: 24722 - protein, 23 aa, Homo sapiens
  Native (PTEN R130Q)
VAAIHCKAGKGQTGVMICAYLLH

SEQ ID NO: 24723 - protein, 24 aa, Homo sapiens
  Native (PTEN R130Q)
VAAIHCKAGKGQTGVMICAYLLHR

SEQ ID NO: 24724 - protein, 25 aa, Homo sapiens
  Native (PTEN R130Q)
VAAIHCKAGKGQTGVMICAYLLHRG

SEQ ID NO: 24725 - protein, 21 aa, Homo sapiens
  Native (TP53 H179R)
AIYKQSQHMTEVVRRCPHRER

SEQ ID NO: 24726 - protein, 22 aa, Homo sapiens
  Native (TP53 H179R)
AIYKQSQHMTEVVRRCPHRERC

SEQ ID NO: 24727 - protein, 23 aa, Homo sapiens
  Native (TP53 H179R)
AIYKQSQHMTEVVRRCPHRERCS

SEQ ID NO: 24728 - protein, 24 aa, Homo sapiens
  Native (TP53 H179R)
AIYKQSQHMTEVVRRCPHRERCSD

SEQ ID NO: 24729 - protein, 25 aa, Homo sapiens
  Native (TP53 H179R)
AIYKQSQHMTEVVRRCPHRERCSDS

SEQ ID NO: 24730 - protein, 23 aa, Homo sapiens
  Native (TP53 H179R)
AMAIYKQSQHMTEVVRRCPHRER

SEQ ID NO: 24731 - protein, 24 aa, Homo sapiens
  Native (TP53 H179R)
AMAIYKQSQHMTEVVRRCPHRERC

SEQ ID NO: 24732 - protein, 25 aa, Homo sapiens
  Native (TP53 H179R)
AMAIYKQSQHMTEVVRRCPHRERCS

SEQ ID NO: 24733 - protein, 15 aa, Homo sapiens
  Native (TP53 H179R)
HMTEVVRRCPHRERC

SEQ ID NO: 24734 - protein, 17 aa, Homo sapiens
  Native (TP53 H179R)
HMTEVVRRCPHRERCSD

SEQ ID NO: 24735 - protein, 20 aa, Homo sapiens
  Native (TP53 H179R)
IYKQSQHMTEVVRRCPHRER

SEQ ID NO: 24736 - protein, 21 aa, Homo sapiens
  Native (TP53 H179R)
IYKQSQHMTEVVRRCPHRERC

SEQ ID NO: 24737 - protein, 22 aa, Homo sapiens
  Native (TP53 H179R)
IYKQSQHMTEVVRRCPHRERCS

SEQ ID NO: 24738 - protein, 23 aa, Homo sapiens
  Native (TP53 H179R)
IYKQSQHMTEVVRRCPHRERCSD

SEQ ID NO: 24739 - protein, 24 aa, Homo sapiens
  Native (TP53 H179R)
IYKQSQHMTEVVRRCPHRERCSDS

SEQ ID NO: 24740 - protein, 25 aa, Homo sapiens
  Native (TP53 H179R)
IYKQSQHMTEVVRRCPHRERCSDSD

SEQ ID NO: 24741 - protein, 20 aa, Homo sapiens
  Native (TP53 H179R)
KQSQHMTEVVRRCPHRERCS

SEQ ID NO: 24742 - protein, 21 aa, Homo sapiens
  Native (TP53 H179R)
KQSQHMTEVVRRCPHRERCSD

SEQ ID NO: 24743 - protein, 22 aa, Homo sapiens
  Native (TP53 H179R)
KQSQHMTEVVRRCPHRERCSDS

SEQ ID NO: 24744 - protein, 23 aa, Homo sapiens
  Native (TP53 H179R)
KQSQHMTEVVRRCPHRERCSDSD

SEQ ID NO: 24745 - protein, 24 aa, Homo sapiens
  Native (TP53 H179R)
KQSQHMTEVVRRCPHRERCSDSDG

SEQ ID NO: 24746 - protein, 25 aa, Homo sapiens
  Native (TP53 H179R)
KQSQHMTEVVRRCPHRERCSDSDGL

SEQ ID NO: 24747 - protein, 22 aa, Homo sapiens
  Native (TP53 H179R)
MAIYKQSQHMTEVVRRCPHRER

SEQ ID NO: 24748 - protein, 23 aa, Homo sapiens
  Native (TP53 H179R)
MAIYKQSQHMTEVVRRCPHRERC

SEQ ID NO: 24749 - protein, 24 aa, Homo sapiens
  Native (TP53 H179R)
MAIYKQSQHMTEVVRRCPHRERCS

SEQ ID NO: 24750 - protein, 25 aa, Homo sapiens
  Native (TP53 H179R)
MAIYKQSQHMTEVVRRCPHRERCSD

SEQ ID NO: 24751 - protein, 15 aa, Homo sapiens
  Native (TP53 H179R)
MTEVVRRCPHRERCS

SEQ ID NO: 24752 - protein, 15 aa, Homo sapiens
  Native (TP53 H179R)
QHMTEVVRRCPHRER

SEQ ID NO: 24753 - protein, 16 aa, Homo sapiens
  Native (TP53 H179R)
QHMTEVVRRCPHRERC

SEQ ID NO: 24754 - protein, 17 aa, Homo sapiens
  Native (TP53 H179R)
QHMTEVVRRCPHRERCS

SEQ ID NO: 24755 - protein, 20 aa, Homo sapiens
  Native (TP53 H179R)
QHMTEVVRRCPHRERCSDSD

SEQ ID NO: 24756 - protein, 23 aa, Homo sapiens
  Native (TP53 H179R)
QHMTEVVRRCPHRERCSDSDGLA

SEQ ID NO: 24757 - protein, 24 aa, Homo sapiens
  Native (TP53 H179R)
QHMTEVVRRCPHRERCSDSDGLAP

SEQ ID NO: 24758 - protein, 25 aa, Homo sapiens
  Native (TP53 H179R)
QHMTEVVRRCPHRERCSDSDGLAPP

SEQ ID NO: 24759 - protein, 17 aa, Homo sapiens
  Native (TP53 H179R)
QSQHMTEVVRRCPHRER

SEQ ID NO: 24760 - protein, 19 aa, Homo sapiens
  Native (TP53 H179R)
QSQHMTEVVRRCPHRERCS

SEQ ID NO: 24761 - protein, 20 aa, Homo sapiens
  Native (TP53 H179R)
QSQHMTEVVRRCPHRERCSD

SEQ ID NO: 24762 - protein, 21 aa, Homo sapiens
  Native (TP53 H179R)
QSQHMTEVVRRCPHRERCSDS

SEQ ID NO: 24763 - protein, 22 aa, Homo sapiens
  Native (TP53 H179R)
QSQHMTEVVRRCPHRERCSDSD

SEQ ID NO: 24764 - protein, 23 aa, Homo sapiens
  Native (TP53 H179R)
QSQHMTEVVRRCPHRERCSDSDG

SEQ ID NO: 24765 - protein, 24 aa, Homo sapiens
  Native (TP53 H179R)
QSQHMTEVVRRCPHRERCSDSDGL

SEQ ID NO: 24766 - protein, 25 aa, Homo sapiens
  Native (TP53 H179R)
QSQHMTEVVRRCPHRERCSDSDGLA

SEQ ID NO: 24767 - protein, 24 aa, Homo sapiens
  Native (TP53 H179R)
RAMAIYKQSQHMTEVVRRCPHRER

SEQ ID NO: 24768 - protein, 25 aa, Homo sapiens
  Native (TP53 H179R)
RAMAIYKQSQHMTEVVRRCPHRERC

SEQ ID NO: 24769 - protein, 17 aa, Homo sapiens
  Native (TP53 H179R)
SQHMTEVVRRCPHRERC

SEQ ID NO: 24770 - protein, 19 aa, Homo sapiens
  Native (TP53 H179R)
SQHMTEVVRRCPHRERCSD

SEQ ID NO: 24771 - protein, 20 aa, Homo sapiens
  Native (TP53 H179R)
SQHMTEVVRRCPHRERCSDS

SEQ ID NO: 24772 - protein, 21 aa, Homo sapiens
  Native (TP53 H179R)
SQHMTEVVRRCPHRERCSDSD

SEQ ID NO: 24773 - protein, 22 aa, Homo sapiens
  Native (TP53 H179R)
SQHMTEVVRRCPHRERCSDSDG

SEQ ID NO: 24774 - protein, 23 aa, Homo sapiens
  Native (TP53 H179R)
SQHMTEVVRRCPHRERCSDSDGL

SEQ ID NO: 24775 - protein, 24 aa, Homo sapiens
  Native (TP53 H179R)
SQHMTEVVRRCPHRERCSDSDGLA

SEQ ID NO: 24776 - protein, 25 aa, Homo sapiens
  Native (TP53 H179R)
SQHMTEVVRRCPHRERCSDSDGLAP

SEQ ID NO: 24777 - protein, 15 aa, Homo sapiens
  Native (TP53 H179R)
TEVVRRCPHRERCSD

SEQ ID NO: 24778 - protein, 20 aa, Homo sapiens
  Native (TP53 H179R)
YKQSQHMTEVVRRCPHRERC

SEQ ID NO: 24779 - protein, 21 aa, Homo sapiens
  Native (TP53 H179R)
YKQSQHMTEVVRRCPHRERCS

SEQ ID NO: 24780 - protein, 22 aa, Homo sapiens
  Native (TP53 H179R)
YKQSQHMTEVVRRCPHRERCSD

SEQ ID NO: 24781 - protein, 23 aa, Homo sapiens
  Native (TP53 H179R)
YKQSQHMTEVVRRCPHRERCSDS

SEQ ID NO: 24782 - protein, 24 aa, Homo sapiens
  Native (TP53 H179R)
YKQSQHMTEVVRRCPHRERCSDSD

SEQ ID NO: 24783 - protein, 25 aa, Homo sapiens
  Native (TP53 H179R)
YKQSQHMTEVVRRCPHRERCSDSDG

SEQ ID NO: 24784 - protein, 25 aa, Homo sapiens
  Native (TP53 R158L)
CPVQLWVDSTPPPGTRVLAMAIYKQ

SEQ ID NO: 24785 - protein, 15 aa, Homo sapiens
  Native (TP53 R158L)
DSTPPPGTRVLAMAI

SEQ ID NO: 24786 - protein, 16 aa, Homo sapiens
  Native (TP53 R158L)
DSTPPPGTRVLAMAIY

SEQ ID NO: 24787 - protein, 17 aa, Homo sapiens
  Native (TP53 R158L)
DSTPPPGTRVLAMAIYK

SEQ ID NO: 24788 - protein, 18 aa, Homo sapiens
  Native (TP53 R158L)
DSTPPPGTRVLAMAIYKQ

SEQ ID NO: 24789 - protein, 19 aa, Homo sapiens
  Native (TP53 R158L)
DSTPPPGTRVLAMAIYKQS

SEQ ID NO: 24790 - protein, 20 aa, Homo sapiens
  Native (TP53 R158L)
DSTPPPGTRVLAMAIYKQSQ

SEQ ID NO: 24791 - protein, 21 aa, Homo sapiens
  Native (TP53 R158L)
DSTPPPGTRVLAMAIYKQSQH

SEQ ID NO: 24792 - protein, 22 aa, Homo sapiens
  Native (TP53 R158L)
DSTPPPGTRVLAMAIYKQSQHM

SEQ ID NO: 24793 - protein, 23 aa, Homo sapiens
  Native (TP53 R158L)
DSTPPPGTRVLAMAIYKQSQHMT

SEQ ID NO: 24794 - protein, 24 aa, Homo sapiens
  Native (TP53 R158L)
DSTPPPGTRVLAMAIYKQSQHMTE

SEQ ID NO: 24795 - protein, 25 aa, Homo sapiens
  Native (TP53 R158L)
DSTPPPGTRVLAMAIYKQSQHMTEV

SEQ ID NO: 24796 - protein, 13 aa, Homo sapiens
  Native (TP53 R158L)
GTRVLAMAIYKQS

SEQ ID NO: 24797 - protein, 14 aa, Homo sapiens
  Native (TP53 R158L)
GTRVLAMAIYKQSQ

SEQ ID NO: 24798 - protein, 15 aa, Homo sapiens
  Native (TP53 R158L)
GTRVLAMAIYKQSQH

SEQ ID NO: 24799 - protein, 16 aa, Homo sapiens
  Native (TP53 R158L)
GTRVLAMAIYKQSQHM

SEQ ID NO: 24800 - protein, 17 aa, Homo sapiens
  Native (TP53 R158L)
GTRVLAMAIYKQSQHMT

SEQ ID NO: 24801 - protein, 18 aa, Homo sapiens
  Native (TP53 R158L)
GTRVLAMAIYKQSQHMTE

SEQ ID NO: 24802 - protein, 19 aa, Homo sapiens
  Native (TP53 R158L)
GTRVLAMAIYKQSQHMTEV

SEQ ID NO: 24803 - protein, 20 aa, Homo sapiens
  Native (TP53 R158L)
GTRVLAMAIYKQSQHMTEVV

SEQ ID NO: 24804 - protein, 21 aa, Homo sapiens
  Native (TP53 R158L)
GTRVLAMAIYKQSQHMTEVVR

SEQ ID NO: 24805 - protein, 22 aa, Homo sapiens
  Native (TP53 R158L)
GTRVLAMAIYKQSQHMTEVVRR

SEQ ID NO: 24806 - protein, 23 aa, Homo sapiens
  Native (TP53 R158L)
GTRVLAMAIYKQSQHMTEVVRRC

SEQ ID NO: 24807 - protein, 24 aa, Homo sapiens
  Native (TP53 R158L)
GTRVLAMAIYKQSQHMTEVVRRCP

SEQ ID NO: 24808 - protein, 25 aa, Homo sapiens
  Native (TP53 R158L)
GTRVLAMAIYKQSQHMTEVVRRCPH

SEQ ID NO: 24809 - protein, 19 aa, Homo sapiens
  Native (TP53 R158L)
LWVDSTPPPGTRVLAMAIY

SEQ ID NO: 24810 - protein, 20 aa, Homo sapiens
  Native (TP53 R158L)
LWVDSTPPPGTRVLAMAIYK

SEQ ID NO: 24811 - protein, 21 aa, Homo sapiens
  Native (TP53 R158L)
LWVDSTPPPGTRVLAMAIYKQ

SEQ ID NO: 24812 - protein, 22 aa, Homo sapiens
  Native (TP53 R158L)
LWVDSTPPPGTRVLAMAIYKQS

SEQ ID NO: 24813 - protein, 23 aa, Homo sapiens
  Native (TP53 R158L)
LWVDSTPPPGTRVLAMAIYKQSQ

SEQ ID NO: 24814 - protein, 24 aa, Homo sapiens
  Native (TP53 R158L)
LWVDSTPPPGTRVLAMAIYKQSQH

SEQ ID NO: 24815 - protein, 25 aa, Homo sapiens
  Native (TP53 R158L)
LWVDSTPPPGTRVLAMAIYKQSQHM

SEQ ID NO: 24816 - protein, 13 aa, Homo sapiens
  Native (TP53 R158L)
PGTRVLAMAIYKQ

SEQ ID NO: 24817 - protein, 14 aa, Homo sapiens
  Native (TP53 R158L)
PGTRVLAMAIYKQS

SEQ ID NO: 24818 - protein, 15 aa, Homo sapiens
  Native (TP53 R158L)
PGTRVLAMAIYKQSQ

SEQ ID NO: 24819 - protein, 16 aa, Homo sapiens
  Native (TP53 R158L)
PGTRVLAMAIYKQSQH

SEQ ID NO: 24820 - protein, 17 aa, Homo sapiens
  Native (TP53 R158L)
PGTRVLAMAIYKQSQHM

SEQ ID NO: 24821 - protein, 18 aa, Homo sapiens
  Native (TP53 R158L)
PGTRVLAMAIYKQSQHMT

SEQ ID NO: 24822 - protein, 19 aa, Homo sapiens
  Native (TP53 R158L)
PGTRVLAMAIYKQSQHMTE

SEQ ID NO: 24823 - protein, 20 aa, Homo sapiens
  Native (TP53 R158L)
PGTRVLAMAIYKQSQHMTEV

SEQ ID NO: 24824 - protein, 21 aa, Homo sapiens
  Native (TP53 R158L)
PGTRVLAMAIYKQSQHMTEVV

SEQ ID NO: 24825 - protein, 22 aa, Homo sapiens
  Native (TP53 R158L)
PGTRVLAMAIYKQSQHMTEVVR

SEQ ID NO: 24826 - protein, 23 aa, Homo sapiens
  Native (TP53 R158L)
PGTRVLAMAIYKQSQHMTEVVRR

SEQ ID NO: 24827 - protein, 24 aa, Homo sapiens
  Native (TP53 R158L)
PGTRVLAMAIYKQSQHMTEVVRRC

SEQ ID NO: 24828 - protein, 25 aa, Homo sapiens
  Native (TP53 R158L)
PGTRVLAMAIYKQSQHMTEVVRRCP

SEQ ID NO: 24829 - protein, 14 aa, Homo sapiens
  Native (TP53 R158L)
PPGTRVLAMAIYKQ

SEQ ID NO: 24830 - protein, 15 aa, Homo sapiens
  Native (TP53 R158L)
PPGTRVLAMAIYKQS

SEQ ID NO: 24831 - protein, 16 aa, Homo sapiens
  Native (TP53 R158L)
PPGTRVLAMAIYKQSQ

SEQ ID NO: 24832 - protein, 17 aa, Homo sapiens
  Native (TP53 R158L)
PPGTRVLAMAIYKQSQH

SEQ ID NO: 24833 - protein, 18 aa, Homo sapiens
  Native (TP53 R158L)
PPGTRVLAMAIYKQSQHM

SEQ ID NO: 24834 - protein, 19 aa, Homo sapiens
  Native (TP53 R158L)
PPGTRVLAMAIYKQSQHMT

SEQ ID NO: 24835 - protein, 20 aa, Homo sapiens
  Native (TP53 R158L)
PPGTRVLAMAIYKQSQHMTE

SEQ ID NO: 24836 - protein, 21 aa, Homo sapiens
  Native (TP53 R158L)
PPGTRVLAMAIYKQSQHMTEV

SEQ ID NO: 24837 - protein, 22 aa, Homo sapiens
  Native (TP53 R158L)
PPGTRVLAMAIYKQSQHMTEVV

SEQ ID NO: 24838 - protein, 23 aa, Homo sapiens
  Native (TP53 R158L)
PPGTRVLAMAIYKQSQHMTEVVR

SEQ ID NO: 24839 - protein, 24 aa, Homo sapiens
  Native (TP53 R158L)
PPGTRVLAMAIYKQSQHMTEVVRR

SEQ ID NO: 24840 - protein, 25 aa, Homo sapiens
  Native (TP53 R158L)
PPGTRVLAMAIYKQSQHMTEVVRRC

SEQ ID NO: 24841 - protein, 15 aa, Homo sapiens
  Native (TP53 R158L)
PPPGTRVLAMAIYKQ

SEQ ID NO: 24842 - protein, 16 aa, Homo sapiens
  Native (TP53 R158L)
PPPGTRVLAMAIYKQS

SEQ ID NO: 24843 - protein, 17 aa, Homo sapiens
  Native (TP53 R158L)
PPPGTRVLAMAIYKQSQ

SEQ ID NO: 24844 - protein, 18 aa, Homo sapiens
  Native (TP53 R158L)
PPPGTRVLAMAIYKQSQH

SEQ ID NO: 24845 - protein, 19 aa, Homo sapiens
  Native (TP53 R158L)
PPPGTRVLAMAIYKQSQHM

SEQ ID NO: 24846 - protein, 20 aa, Homo sapiens
  Native (TP53 R158L)
PPPGTRVLAMAIYKQSQHMT

SEQ ID NO: 24847 - protein, 21 aa, Homo sapiens
  Native (TP53 R158L)
PPPGTRVLAMAIYKQSQHMTE

SEQ ID NO: 24848 - protein, 22 aa, Homo sapiens
  Native (TP53 R158L)
PPPGTRVLAMAIYKQSQHMTEV

SEQ ID NO: 24849 - protein, 23 aa, Homo sapiens
  Native (TP53 R158L)
PPPGTRVLAMAIYKQSQHMTEVV

SEQ ID NO: 24850 - protein, 24 aa, Homo sapiens
  Native (TP53 R158L)
PPPGTRVLAMAIYKQSQHMTEVVR

SEQ ID NO: 24851 - protein, 25 aa, Homo sapiens
  Native (TP53 R158L)
PPPGTRVLAMAIYKQSQHMTEVVRR

SEQ ID NO: 24852 - protein, 24 aa, Homo sapiens
  Native (TP53 R158L)
PVQLWVDSTPPPGTRVLAMAIYKQ

SEQ ID NO: 24853 - protein, 25 aa, Homo sapiens
  Native (TP53 R158L)
PVQLWVDSTPPPGTRVLAMAIYKQS

SEQ ID NO: 24854 - protein, 22 aa, Homo sapiens
  Native (TP53 R158L)
QLWVDSTPPPGTRVLAMAIYKQ

SEQ ID NO: 24855 - protein, 23 aa, Homo sapiens
  Native (TP53 R158L)
QLWVDSTPPPGTRVLAMAIYKQS

SEQ ID NO: 24856 - protein, 24 aa, Homo sapiens
  Native (TP53 R158L)
QLWVDSTPPPGTRVLAMAIYKQSQ

SEQ ID NO: 24857 - protein, 25 aa, Homo sapiens
  Native (TP53 R158L)
QLWVDSTPPPGTRVLAMAIYKQSQH

SEQ ID NO: 24858 - protein, 13 aa, Homo sapiens
  Native (TP53 R158L)
RVLAMAIYKQSQH

SEQ ID NO: 24859 - protein, 14 aa, Homo sapiens
  Native (TP53 R158L)
RVLAMAIYKQSQHM

SEQ ID NO: 24860 - protein, 15 aa, Homo sapiens
  Native (TP53 R158L)
RVLAMAIYKQSQHMT

SEQ ID NO: 24861 - protein, 16 aa, Homo sapiens
  Native (TP53 R158L)
RVLAMAIYKQSQHMTE

SEQ ID NO: 24862 - protein, 17 aa, Homo sapiens
  Native (TP53 R158L)
RVLAMAIYKQSQHMTEV

SEQ ID NO: 24863 - protein, 19 aa, Homo sapiens
  Native (TP53 R158L)
RVLAMAIYKQSQHMTEVVR

SEQ ID NO: 24864 - protein, 20 aa, Homo sapiens
  Native (TP53 R158L)
RVLAMAIYKQSQHMTEVVRR

SEQ ID NO: 24865 - protein, 21 aa, Homo sapiens
  Native (TP53 R158L)
RVLAMAIYKQSQHMTEVVRRC

SEQ ID NO: 24866 - protein, 22 aa, Homo sapiens
  Native (TP53 R158L)
RVLAMAIYKQSQHMTEVVRRCP

SEQ ID NO: 24867 - protein, 23 aa, Homo sapiens
  Native (TP53 R158L)
RVLAMAIYKQSQHMTEVVRRCPH

SEQ ID NO: 24868 - protein, 24 aa, Homo sapiens
  Native (TP53 R158L)
RVLAMAIYKQSQHMTEVVRRCPHH

SEQ ID NO: 24869 - protein, 25 aa, Homo sapiens
  Native (TP53 R158L)
RVLAMAIYKQSQHMTEVVRRCPHHE

SEQ ID NO: 24870 - protein, 15 aa, Homo sapiens
  Native (TP53 R158L)
STPPPGTRVLAMAIY

SEQ ID NO: 24871 - protein, 16 aa, Homo sapiens
  Native (TP53 R158L)
STPPPGTRVLAMAIYK

SEQ ID NO: 24872 - protein, 17 aa, Homo sapiens
  Native (TP53 R158L)
STPPPGTRVLAMAIYKQ

SEQ ID NO: 24873 - protein, 18 aa, Homo sapiens
  Native (TP53 R158L)
STPPPGTRVLAMAIYKQS

SEQ ID NO: 24874 - protein, 19 aa, Homo sapiens
  Native (TP53 R158L)
STPPPGTRVLAMAIYKQSQ

SEQ ID NO: 24875 - protein, 20 aa, Homo sapiens
  Native (TP53 R158L)
STPPPGTRVLAMAIYKQSQH

SEQ ID NO: 24876 - protein, 21 aa, Homo sapiens
  Native (TP53 R158L)
STPPPGTRVLAMAIYKQSQHM

SEQ ID NO: 24877 - protein, 22 aa, Homo sapiens
  Native (TP53 R158L)
STPPPGTRVLAMAIYKQSQHMT

SEQ ID NO: 24878 - protein, 23 aa, Homo sapiens
  Native (TP53 R158L)
STPPPGTRVLAMAIYKQSQHMTE

SEQ ID NO: 24879 - protein, 24 aa, Homo sapiens
  Native (TP53 R158L)
STPPPGTRVLAMAIYKQSQHMTEV

SEQ ID NO: 24880 - protein, 25 aa, Homo sapiens
  Native (TP53 R158L)
STPPPGTRVLAMAIYKQSQHMTEVV

SEQ ID NO: 24881 - protein, 15 aa, Homo sapiens
  Native (TP53 R158L)
TPPPGTRVLAMAIYK

SEQ ID NO: 24882 - protein, 16 aa, Homo sapiens
  Native (TP53 R158L)
TPPPGTRVLAMAIYKQ

SEQ ID NO: 24883 - protein, 17 aa, Homo sapiens
  Native (TP53 R158L)
TPPPGTRVLAMAIYKQS

SEQ ID NO: 24884 - protein, 18 aa, Homo sapiens
  Native (TP53 R158L)
TPPPGTRVLAMAIYKQSQ

SEQ ID NO: 24885 - protein, 19 aa, Homo sapiens
  Native (TP53 R158L)
TPPPGTRVLAMAIYKQSQH

SEQ ID NO: 24886 - protein, 20 aa, Homo sapiens
  Native (TP53 R158L)
TPPPGTRVLAMAIYKQSQHM

SEQ ID NO: 24887 - protein, 21 aa, Homo sapiens
  Native (TP53 R158L)
TPPPGTRVLAMAIYKQSQHMT

SEQ ID NO: 24888 - protein, 22 aa, Homo sapiens
  Native (TP53 R158L)
TPPPGTRVLAMAIYKQSQHMTE

SEQ ID NO: 24889 - protein, 23 aa, Homo sapiens
  Native (TP53 R158L)
TPPPGTRVLAMAIYKQSQHMTEV

SEQ ID NO: 24890 - protein, 24 aa, Homo sapiens
  Native (TP53 R158L)
TPPPGTRVLAMAIYKQSQHMTEVV

SEQ ID NO: 24891 - protein, 25 aa, Homo sapiens
  Native (TP53 R158L)
TPPPGTRVLAMAIYKQSQHMTEVVR

SEQ ID NO: 24892 - protein, 13 aa, Homo sapiens
  Native (TP53 R158L)
TRVLAMAIYKQSQ

SEQ ID NO: 24893 - protein, 14 aa, Homo sapiens
  Native (TP53 R158L)
TRVLAMAIYKQSQH

SEQ ID NO: 24894 - protein, 15 aa, Homo sapiens
  Native (TP53 R158L)
TRVLAMAIYKQSQHM

SEQ ID NO: 24895 - protein, 16 aa, Homo sapiens
  Native (TP53 R158L)
TRVLAMAIYKQSQHMT

SEQ ID NO: 24896 - protein, 17 aa, Homo sapiens
  Native (TP53 R158L)
TRVLAMAIYKQSQHMTE

SEQ ID NO: 24897 - protein, 18 aa, Homo sapiens
  Native (TP53 R158L)
TRVLAMAIYKQSQHMTEV

SEQ ID NO: 24898 - protein, 19 aa, Homo sapiens
  Native (TP53 R158L)
TRVLAMAIYKQSQHMTEVV

SEQ ID NO: 24899 - protein, 20 aa, Homo sapiens
  Native (TP53 R158L)
TRVLAMAIYKQSQHMTEVVR

SEQ ID NO: 24900 - protein, 21 aa, Homo sapiens
  Native (TP53 R158L)
TRVLAMAIYKQSQHMTEVVRR

SEQ ID NO: 24901 - protein, 22 aa, Homo sapiens
  Native (TP53 R158L)
TRVLAMAIYKQSQHMTEVVRRC

SEQ ID NO: 24902 - protein, 23 aa, Homo sapiens
  Native (TP53 R158L)
TRVLAMAIYKQSQHMTEVVRRCP

SEQ ID NO: 24903 - protein, 24 aa, Homo sapiens
  Native (TP53 R158L)
TRVLAMAIYKQSQHMTEVVRRCPH

SEQ ID NO: 24904 - protein, 25 aa, Homo sapiens
  Native (TP53 R158L)
TRVLAMAIYKQSQHMTEVVRRCPHH

SEQ ID NO: 24905 - protein, 15 aa, Homo sapiens
  Native (TP53 R158L)
VDSTPPPGTRVLAMA

SEQ ID NO: 24906 - protein, 16 aa, Homo sapiens
  Native (TP53 R158L)
VDSTPPPGTRVLAMAI

SEQ ID NO: 24907 - protein, 17 aa, Homo sapiens
  Native (TP53 R158L)
VDSTPPPGTRVLAMAIY

SEQ ID NO: 24908 - protein, 19 aa, Homo sapiens
  Native (TP53 R158L)
VDSTPPPGTRVLAMAIYKQ

SEQ ID NO: 24909 - protein, 20 aa, Homo sapiens
  Native (TP53 R158L)
VDSTPPPGTRVLAMAIYKQS

SEQ ID NO: 24910 - protein, 21 aa, Homo sapiens
  Native (TP53 R158L)
VDSTPPPGTRVLAMAIYKQSQ

SEQ ID NO: 24911 - protein, 22 aa, Homo sapiens
  Native (TP53 R158L)
VDSTPPPGTRVLAMAIYKQSQH

SEQ ID NO: 24912 - protein, 23 aa, Homo sapiens
  Native (TP53 R158L)
VDSTPPPGTRVLAMAIYKQSQHM

SEQ ID NO: 24913 - protein, 24 aa, Homo sapiens
  Native (TP53 R158L)
VDSTPPPGTRVLAMAIYKQSQHMT

SEQ ID NO: 24914 - protein, 25 aa, Homo sapiens
  Native (TP53 R158L)
VDSTPPPGTRVLAMAIYKQSQHMTE

SEQ ID NO: 24915 - protein, 23 aa, Homo sapiens
  Native (TP53 R158L)
VQLWVDSTPPPGTRVLAMAIYKQ

SEQ ID NO: 24916 - protein, 24 aa, Homo sapiens
  Native (TP53 R158L)
VQLWVDSTPPPGTRVLAMAIYKQS

SEQ ID NO: 24917 - protein, 25 aa, Homo sapiens
  Native (TP53 R158L)
VQLWVDSTPPPGTRVLAMAIYKQSQ

SEQ ID NO: 24918 - protein, 15 aa, Homo sapiens
  Native (TP53 R158L)
WVDSTPPPGTRVLAM

SEQ ID NO: 24919 - protein, 16 aa, Homo sapiens
  Native (TP53 R158L)
WVDSTPPPGTRVLAMA

SEQ ID NO: 24920 - protein, 17 aa, Homo sapiens
  Native (TP53 R158L)
WVDSTPPPGTRVLAMAI

SEQ ID NO: 24921 - protein, 19 aa, Homo sapiens
  Native (TP53 R158L)
WVDSTPPPGTRVLAMAIYK

SEQ ID NO: 24922 - protein, 20 aa, Homo sapiens
  Native (TP53 R158L)
WVDSTPPPGTRVLAMAIYKQ

SEQ ID NO: 24923 - protein, 21 aa, Homo sapiens
  Native (TP53 R158L)
WVDSTPPPGTRVLAMAIYKQS

SEQ ID NO: 24924 - protein, 22 aa, Homo sapiens
  Native (TP53 R158L)
WVDSTPPPGTRVLAMAIYKQSQ

SEQ ID NO: 24925 - protein, 23 aa, Homo sapiens
  Native (TP53 R158L)
WVDSTPPPGTRVLAMAIYKQSQH

SEQ ID NO: 24926 - protein, 24 aa, Homo sapiens
  Native (TP53 R158L)
WVDSTPPPGTRVLAMAIYKQSQHM

SEQ ID NO: 24927 - protein, 25 aa, Homo sapiens
  Native (TP53 R158L)
WVDSTPPPGTRVLAMAIYKQSQHMT

SEQ ID NO: 24928 - protein, 20 aa, Homo sapiens
  Native (TP53 R175H)
AIYKQSQHMTEVVRHCPHHE

SEQ ID NO: 24929 - protein, 24 aa, Homo sapiens
  Native (TP53 R175H)
AIYKQSQHMTEVVRHCPHHERCSD

SEQ ID NO: 24930 - protein, 25 aa, Homo sapiens
  Native (TP53 R175H)
AIYKQSQHMTEVVRHCPHHERCSDS

SEQ ID NO: 24931 - protein, 21 aa, Homo sapiens
  Native (TP53 R175H)
AMAIYKQSQHMTEVVRHCPHH

SEQ ID NO: 24932 - protein, 22 aa, Homo sapiens
  Native (TP53 R175H)
AMAIYKQSQHMTEVVRHCPHHE

SEQ ID NO: 24933 - protein, 23 aa, Homo sapiens
  Native (TP53 R175H)
AMAIYKQSQHMTEVVRHCPHHER

SEQ ID NO: 24934 - protein, 24 aa, Homo sapiens
  Native (TP53 R175H)
AMAIYKQSQHMTEVVRHCPHHERC

SEQ ID NO: 24935 - protein, 25 aa, Homo sapiens
  Native (TP53 R175H)
AMAIYKQSQHMTEVVRHCPHHERCS

SEQ ID NO: 24936 - protein, 15 aa, Homo sapiens
  Native (TP53 R175H)
HMTEVVRHCPHHERC

SEQ ID NO: 24937 - protein, 20 aa, Homo sapiens
  Native (TP53 R175H)
IYKQSQHMTEVVRHCPHHER

SEQ ID NO: 24938 - protein, 23 aa, Homo sapiens
  Native (TP53 R175H)
IYKQSQHMTEVVRHCPHHERCSD

SEQ ID NO: 24939 - protein, 24 aa, Homo sapiens
  Native (TP53 R175H)
IYKQSQHMTEVVRHCPHHERCSDS

SEQ ID NO: 24940 - protein, 25 aa, Homo sapiens
  Native (TP53 R175H)
IYKQSQHMTEVVRHCPHHERCSDSD

SEQ ID NO: 24941 - protein, 20 aa, Homo sapiens
  Native (TP53 R175H)
MAIYKQSQHMTEVVRHCPHH

SEQ ID NO: 24942 - protein, 21 aa, Homo sapiens
  Native (TP53 R175H)
MAIYKQSQHMTEVVRHCPHHE

SEQ ID NO: 24943 - protein, 22 aa, Homo sapiens
  Native (TP53 R175H)
MAIYKQSQHMTEVVRHCPHHER

SEQ ID NO: 24944 - protein, 23 aa, Homo sapiens
  Native (TP53 R175H)
MAIYKQSQHMTEVVRHCPHHERC

SEQ ID NO: 24945 - protein, 24 aa, Homo sapiens
  Native (TP53 R175H)
MAIYKQSQHMTEVVRHCPHHERCS

SEQ ID NO: 24946 - protein, 25 aa, Homo sapiens
  Native (TP53 R175H)
MAIYKQSQHMTEVVRHCPHHERCSD

SEQ ID NO: 24947 - protein, 22 aa, Homo sapiens
  Native (TP53 R175H)
RAMAIYKQSQHMTEVVRHCPHH

SEQ ID NO: 24948 - protein, 23 aa, Homo sapiens
  Native (TP53 R175H)
RAMAIYKQSQHMTEVVRHCPHHE

SEQ ID NO: 24949 - protein, 24 aa, Homo sapiens
  Native (TP53 R175H)
RAMAIYKQSQHMTEVVRHCPHHER

SEQ ID NO: 24950 - protein, 25 aa, Homo sapiens
  Native (TP53 R175H)
RAMAIYKQSQHMTEVVRHCPHHERC

SEQ ID NO: 24951 - protein, 25 aa, Homo sapiens
  Native (TP53 R175H)
RVRAMAIYKQSQHMTEVVRHCPHHE

SEQ ID NO: 24952 - protein, 15 aa, Homo sapiens
  Native (TP53 R175H)
SQHMTEVVRHCPHHE

SEQ ID NO: 24953 - protein, 24 aa, Homo sapiens
  Native (TP53 R175H)
VRAMAIYKQSQHMTEVVRHCPHHE

SEQ ID NO: 24954 - protein, 25 aa, Homo sapiens
  Native (TP53 R175H)
VRAMAIYKQSQHMTEVVRHCPHHER

SEQ ID NO: 24955 - protein, 15 aa, Homo sapiens
  Native (TP53 R248Q)
CMGGMNQRPILTIIT

SEQ ID NO: 24956 - protein, 16 aa, Homo sapiens
  Native (TP53 R248Q)
CMGGMNQRPILTIITL

SEQ ID NO: 24957 - protein, 17 aa, Homo sapiens
  Native (TP53 R248Q)
CMGGMNQRPILTIITLE

SEQ ID NO: 24958 - protein, 19 aa, Homo sapiens
  Native (TP53 R248Q)
CMGGMNQRPILTIITLEDS

SEQ ID NO: 24959 - protein, 20 aa, Homo sapiens
  Native (TP53 R248Q)
CMGGMNQRPILTIITLEDSS

SEQ ID NO: 24960 - protein, 20 aa, Homo sapiens
  Native (TP53 R248Q)
CNSSCMGGMNQRPILTIITL

SEQ ID NO: 24961 - protein, 22 aa, Homo sapiens
  Native (TP53 R248Q)
CNSSCMGGMNQRPILTIITLED

SEQ ID NO: 24962 - protein, 23 aa, Homo sapiens
  Native (TP53 R248Q)
CNSSCMGGMNQRPILTIITLEDS

SEQ ID NO: 24963 - protein, 24 aa, Homo sapiens
  Native (TP53 R248Q)
CNSSCMGGMNQRPILTIITLEDSS

SEQ ID NO: 24964 - protein, 25 aa, Homo sapiens
  Native (TP53 R248Q)
CNSSCMGGMNQRPILTIITLEDSSG

SEQ ID NO: 24965 - protein, 25 aa, Homo sapiens
  Native (TP53 R248Q)
CTTIHYNYMCNSSCMGGMNQRPILT

SEQ ID NO: 24966 - protein, 15 aa, Homo sapiens
  Native (TP53 R248Q)
GGMNQRPILTIITLE

SEQ ID NO: 24967 - protein, 16 aa, Homo sapiens
  Native (TP53 R248Q)
GGMNQRPILTIITLED

SEQ ID NO: 24968 - protein, 17 aa, Homo sapiens
  Native (TP53 R248Q)
GGMNQRPILTIITLEDS

SEQ ID NO: 24969 - protein, 24 aa, Homo sapiens
  Native (TP53 R248Q)
HYNYMCNSSCMGGMNQRPILTIIT

SEQ ID NO: 24970 - protein, 25 aa, Homo sapiens
  Native (TP53 R248Q)
HYNYMCNSSCMGGMNQRPILTIITL

SEQ ID NO: 24971 - protein, 24 aa, Homo sapiens
  Native (TP53 R248Q)
IHYNYMCNSSCMGGMNQRPILTII

SEQ ID NO: 24972 - protein, 25 aa, Homo sapiens
  Native (TP53 R248Q)
IHYNYMCNSSCMGGMNQRPILTIIT

SEQ ID NO: 24973 - protein, 20 aa, Homo sapiens
  Native (TP53 R248Q)
MCNSSCMGGMNQRPILTIIT

SEQ ID NO: 24974 - protein, 23 aa, Homo sapiens
  Native (TP53 R248Q)
MCNSSCMGGMNQRPILTIITLED

SEQ ID NO: 24975 - protein, 24 aa, Homo sapiens
  Native (TP53 R248Q)
MCNSSCMGGMNQRPILTIITLEDS

SEQ ID NO: 24976 - protein, 25 aa, Homo sapiens
  Native (TP53 R248Q)
MCNSSCMGGMNQRPILTIITLEDSS

SEQ ID NO: 24977 - protein, 15 aa, Homo sapiens
  Native (TP53 R248Q)
MGGMNQRPILTIITL

SEQ ID NO: 24978 - protein, 17 aa, Homo sapiens
  Native (TP53 R248Q)
MGGMNQRPILTIITLED

SEQ ID NO: 24979 - protein, 18 aa, Homo sapiens
  Native (TP53 R248Q)
MGGMNQRPILTIITLEDS

SEQ ID NO: 24980 - protein, 19 aa, Homo sapiens
  Native (TP53 R248Q)
MGGMNQRPILTIITLEDSS

SEQ ID NO: 24981 - protein, 20 aa, Homo sapiens
  Native (TP53 R248Q)
NSSCMGGMNQRPILTIITLE

SEQ ID NO: 24982 - protein, 21 aa, Homo sapiens
  Native (TP53 R248Q)
NSSCMGGMNQRPILTIITLED

SEQ ID NO: 24983 - protein, 22 aa, Homo sapiens
  Native (TP53 R248Q)
NSSCMGGMNQRPILTIITLEDS

SEQ ID NO: 24984 - protein, 23 aa, Homo sapiens
  Native (TP53 R248Q)
NSSCMGGMNQRPILTIITLEDSS

SEQ ID NO: 24985 - protein, 24 aa, Homo sapiens
  Native (TP53 R248Q)
NSSCMGGMNQRPILTIITLEDSSG

SEQ ID NO: 24986 - protein, 20 aa, Homo sapiens
  Native (TP53 R248Q)
NYMCNSSCMGGMNQRPILTI

SEQ ID NO: 24987 - protein, 23 aa, Homo sapiens
  Native (TP53 R248Q)
NYMCNSSCMGGMNQRPILTIITL

SEQ ID NO: 24988 - protein, 24 aa, Homo sapiens
  Native (TP53 R248Q)
NYMCNSSCMGGMNQRPILTIITLE

SEQ ID NO: 24989 - protein, 25 aa, Homo sapiens
  Native (TP53 R248Q)
NYMCNSSCMGGMNQRPILTIITLED

SEQ ID NO: 24990 - protein, 15 aa, Homo sapiens
  Native (TP53 R248Q)
SCMGGMNQRPILTII

SEQ ID NO: 24991 - protein, 17 aa, Homo sapiens
  Native (TP53 R248Q)
SCMGGMNQRPILTIITL

SEQ ID NO: 24992 - protein, 19 aa, Homo sapiens
  Native (TP53 R248Q)
SCMGGMNQRPILTIITLED

SEQ ID NO: 24993 - protein, 20 aa, Homo sapiens
  Native (TP53 R248Q)
SCMGGMNQRPILTIITLEDS

SEQ ID NO: 24994 - protein, 21 aa, Homo sapiens
  Native (TP53 R248Q)
SCMGGMNQRPILTIITLEDSS

SEQ ID NO: 24995 - protein, 19 aa, Homo sapiens
  Native (TP53 R248Q)
SSCMGGMNQRPILTIITLE

SEQ ID NO: 24996 - protein, 20 aa, Homo sapiens
  Native (TP53 R248Q)
SSCMGGMNQRPILTIITLED

SEQ ID NO: 24997 - protein, 21 aa, Homo sapiens
  Native (TP53 R248Q)
SSCMGGMNQRPILTIITLEDS

SEQ ID NO: 24998 - protein, 22 aa, Homo sapiens
  Native (TP53 R248Q)
SSCMGGMNQRPILTIITLEDSS

SEQ ID NO: 24999 - protein, 24 aa, Homo sapiens
  Native (TP53 R248Q)
TIHYNYMCNSSCMGGMNQRPILTI

SEQ ID NO: 25000 - protein, 25 aa, Homo sapiens
  Native (TP53 R248Q)
TIHYNYMCNSSCMGGMNQRPILTII

SEQ ID NO: 25001 - protein, 24 aa, Homo sapiens
  Native (TP53 R248Q)
TTIHYNYMCNSSCMGGMNQRPILT

SEQ ID NO: 25002 - protein, 25 aa, Homo sapiens
  Native (TP53 R248Q)
TTIHYNYMCNSSCMGGMNQRPILTI

SEQ ID NO: 25003 - protein, 20 aa, Homo sapiens
  Native (TP53 R248Q)
YMCNSSCMGGMNQRPILTII

SEQ ID NO: 25004 - protein, 22 aa, Homo sapiens
  Native (TP53 R248Q)
YMCNSSCMGGMNQRPILTIITL

SEQ ID NO: 25005 - protein, 24 aa, Homo sapiens
  Native (TP53 R248Q)
YMCNSSCMGGMNQRPILTIITLED

SEQ ID NO: 25006 - protein, 25 aa, Homo sapiens
  Native (TP53 R248Q)
YMCNSSCMGGMNQRPILTIITLEDS

SEQ ID NO: 25007 - protein, 20 aa, Homo sapiens
  Native (TP53 R248Q)
YNYMCNSSCMGGMNQRPILT

SEQ ID NO: 25008 - protein, 23 aa, Homo sapiens
  Native (TP53 R248Q)
YNYMCNSSCMGGMNQRPILTIIT

SEQ ID NO: 25009 - protein, 24 aa, Homo sapiens
  Native (TP53 R248Q)
YNYMCNSSCMGGMNQRPILTIITL

SEQ ID NO: 25010 - protein, 25 aa, Homo sapiens
  Native (TP53 R248Q)
YNYMCNSSCMGGMNQRPILTIITLE

SEQ ID NO: 25011 - protein, 14 aa, Homo sapiens
  Native (TP53 R248W)
CMGGMNWRPILTII

SEQ ID NO: 25012 - protein, 15 aa, Homo sapiens
  Native (TP53 R248W)
CMGGMNWRPILTIIT

SEQ ID NO: 25013 - protein, 16 aa, Homo sapiens
  Native (TP53 R248W)
CMGGMNWRPILTIITL

SEQ ID NO: 25014 - protein, 17 aa, Homo sapiens
  Native (TP53 R248W)
CMGGMNWRPILTIITLE

SEQ ID NO: 25015 - protein, 18 aa, Homo sapiens
  Native (TP53 R248W)
CMGGMNWRPILTIITLED

SEQ ID NO: 25016 - protein, 19 aa, Homo sapiens
  Native (TP53 R248W)
CMGGMNWRPILTIITLEDS

SEQ ID NO: 25017 - protein, 20 aa, Homo sapiens
  Native (TP53 R248W)
CMGGMNWRPILTIITLEDSS

SEQ ID NO: 25018 - protein, 21 aa, Homo sapiens
  Native (TP53 R248W)
CMGGMNWRPILTIITLEDSSG

SEQ ID NO: 25019 - protein, 17 aa, Homo sapiens
  Native (TP53 R248W)
CNSSCMGGMNWRPILTI

SEQ ID NO: 25020 - protein, 18 aa, Homo sapiens
  Native (TP53 R248W)
CNSSCMGGMNWRPILTII

SEQ ID NO: 25021 - protein, 19 aa, Homo sapiens
  Native (TP53 R248W)
CNSSCMGGMNWRPILTIIT

SEQ ID NO: 25022 - protein, 20 aa, Homo sapiens
  Native (TP53 R248W)
CNSSCMGGMNWRPILTIITL

SEQ ID NO: 25023 - protein, 21 aa, Homo sapiens
  Native (TP53 R248W)
CNSSCMGGMNWRPILTIITLE

SEQ ID NO: 25024 - protein, 22 aa, Homo sapiens
  Native (TP53 R248W)
CNSSCMGGMNWRPILTIITLED

SEQ ID NO: 25025 - protein, 23 aa, Homo sapiens
  Native (TP53 R248W)
CNSSCMGGMNWRPILTIITLEDS

SEQ ID NO: 25026 - protein, 24 aa, Homo sapiens
  Native (TP53 R248W)
CNSSCMGGMNWRPILTIITLEDSS

SEQ ID NO: 25027 - protein, 25 aa, Homo sapiens
  Native (TP53 R248W)
CNSSCMGGMNWRPILTIITLEDSSG

SEQ ID NO: 25028 - protein, 14 aa, Homo sapiens
  Native (TP53 R248W)
GGMNWRPILTIITL

SEQ ID NO: 25029 - protein, 15 aa, Homo sapiens
  Native (TP53 R248W)
GGMNWRPILTIITLE

SEQ ID NO: 25030 - protein, 16 aa, Homo sapiens
  Native (TP53 R248W)
GGMNWRPILTIITLED

SEQ ID NO: 25031 - protein, 17 aa, Homo sapiens
  Native (TP53 R248W)
GGMNWRPILTIITLEDS

SEQ ID NO: 25032 - protein, 18 aa, Homo sapiens
  Native (TP53 R248W)
GGMNWRPILTIITLEDSS

SEQ ID NO: 25033 - protein, 13 aa, Homo sapiens
  Native (TP53 R248W)
GMNWRPILTIITL

SEQ ID NO: 25034 - protein, 14 aa, Homo sapiens
  Native (TP53 R248W)
GMNWRPILTIITLE

SEQ ID NO: 25035 - protein, 22 aa, Homo sapiens
  Native (TP53 R248W)
HYNYMCNSSCMGGMNWRPILTI

SEQ ID NO: 25036 - protein, 23 aa, Homo sapiens
  Native (TP53 R248W)
HYNYMCNSSCMGGMNWRPILTII

SEQ ID NO: 25037 - protein, 24 aa, Homo sapiens
  Native (TP53 R248W)
HYNYMCNSSCMGGMNWRPILTIIT

SEQ ID NO: 25038 - protein, 25 aa, Homo sapiens
  Native (TP53 R248W)
HYNYMCNSSCMGGMNWRPILTIITL

SEQ ID NO: 25039 - protein, 23 aa, Homo sapiens
  Native (TP53 R248W)
IHYNYMCNSSCMGGMNWRPILTI

SEQ ID NO: 25040 - protein, 24 aa, Homo sapiens
  Native (TP53 R248W)
IHYNYMCNSSCMGGMNWRPILTII

SEQ ID NO: 25041 - protein, 25 aa, Homo sapiens
  Native (TP53 R248W)
IHYNYMCNSSCMGGMNWRPILTIIT

SEQ ID NO: 25042 - protein, 19 aa, Homo sapiens
  Native (TP53 R248W)
MCNSSCMGGMNWRPILTII

SEQ ID NO: 25043 - protein, 20 aa, Homo sapiens
  Native (TP53 R248W)
MCNSSCMGGMNWRPILTIIT

SEQ ID NO: 25044 - protein, 21 aa, Homo sapiens
  Native (TP53 R248W)
MCNSSCMGGMNWRPILTIITL

SEQ ID NO: 25045 - protein, 22 aa, Homo sapiens
  Native (TP53 R248W)
MCNSSCMGGMNWRPILTIITLE

SEQ ID NO: 25046 - protein, 23 aa, Homo sapiens
  Native (TP53 R248W)
MCNSSCMGGMNWRPILTIITLED

SEQ ID NO: 25047 - protein, 24 aa, Homo sapiens
  Native (TP53 R248W)
MCNSSCMGGMNWRPILTIITLEDS

SEQ ID NO: 25048 - protein, 25 aa, Homo sapiens
  Native (TP53 R248W)
MCNSSCMGGMNWRPILTIITLEDSS

SEQ ID NO: 25049 - protein, 13 aa, Homo sapiens
  Native (TP53 R248W)
MGGMNWRPILTII

SEQ ID NO: 25050 - protein, 14 aa, Homo sapiens
  Native (TP53 R248W)
MGGMNWRPILTIIT

SEQ ID NO: 25051 - protein, 15 aa, Homo sapiens
  Native (TP53 R248W)
MGGMNWRPILTIITL

SEQ ID NO: 25052 - protein, 16 aa, Homo sapiens
  Native (TP53 R248W)
MGGMNWRPILTIITLE

SEQ ID NO: 25053 - protein, 17 aa, Homo sapiens
  Native (TP53 R248W)
MGGMNWRPILTIITLED

SEQ ID NO: 25054 - protein, 18 aa, Homo sapiens
  Native (TP53 R248W)
MGGMNWRPILTIITLEDS

SEQ ID NO: 25055 - protein, 19 aa, Homo sapiens
  Native (TP53 R248W)
MGGMNWRPILTIITLEDSS

SEQ ID NO: 25056 - protein, 20 aa, Homo sapiens
  Native (TP53 R248W)
MGGMNWRPILTIITLEDSSG

SEQ ID NO: 25057 - protein, 16 aa, Homo sapiens
  Native (TP53 R248W)
NSSCMGGMNWRPILTI

SEQ ID NO: 25058 - protein, 17 aa, Homo sapiens
  Native (TP53 R248W)
NSSCMGGMNWRPILTII

SEQ ID NO: 25059 - protein, 18 aa, Homo sapiens
  Native (TP53 R248W)
NSSCMGGMNWRPILTIIT

SEQ ID NO: 25060 - protein, 19 aa, Homo sapiens
  Native (TP53 R248W)
NSSCMGGMNWRPILTIITL

SEQ ID NO: 25061 - protein, 20 aa, Homo sapiens
  Native (TP53 R248W)
NSSCMGGMNWRPILTIITLE

SEQ ID NO: 25062 - protein, 21 aa, Homo sapiens
  Native (TP53 R248W)
NSSCMGGMNWRPILTIITLED

SEQ ID NO: 25063 - protein, 22 aa, Homo sapiens
  Native (TP53 R248W)
NSSCMGGMNWRPILTIITLEDS

SEQ ID NO: 25064 - protein, 23 aa, Homo sapiens
  Native (TP53 R248W)
NSSCMGGMNWRPILTIITLEDSS

SEQ ID NO: 25065 - protein, 24 aa, Homo sapiens
  Native (TP53 R248W)
NSSCMGGMNWRPILTIITLEDSSG

SEQ ID NO: 25066 - protein, 25 aa, Homo sapiens
  Native (TP53 R248W)
NSSCMGGMNWRPILTIITLEDSSGN

SEQ ID NO: 25067 - protein, 20 aa, Homo sapiens
  Native (TP53 R248W)
NYMCNSSCMGGMNWRPILTI

SEQ ID NO: 25068 - protein, 21 aa, Homo sapiens
  Native (TP53 R248W)
NYMCNSSCMGGMNWRPILTII

SEQ ID NO: 25069 - protein, 22 aa, Homo sapiens
  Native (TP53 R248W)
NYMCNSSCMGGMNWRPILTIIT

SEQ ID NO: 25070 - protein, 23 aa, Homo sapiens
  Native (TP53 R248W)
NYMCNSSCMGGMNWRPILTIITL

SEQ ID NO: 25071 - protein, 24 aa, Homo sapiens
  Native (TP53 R248W)
NYMCNSSCMGGMNWRPILTIITLE

SEQ ID NO: 25072 - protein, 25 aa, Homo sapiens
  Native (TP53 R248W)
NYMCNSSCMGGMNWRPILTIITLED

SEQ ID NO: 25073 - protein, 14 aa, Homo sapiens
  Native (TP53 R248W)
SCMGGMNWRPILTI

SEQ ID NO: 25074 - protein, 15 aa, Homo sapiens
  Native (TP53 R248W)
SCMGGMNWRPILTII

SEQ ID NO: 25075 - protein, 16 aa, Homo sapiens
  Native (TP53 R248W)
SCMGGMNWRPILTIIT

SEQ ID NO: 25076 - protein, 17 aa, Homo sapiens
  Native (TP53 R248W)
SCMGGMNWRPILTIITL

SEQ ID NO: 25077 - protein, 18 aa, Homo sapiens
  Native (TP53 R248W)
SCMGGMNWRPILTIITLE

SEQ ID NO: 25078 - protein, 19 aa, Homo sapiens
  Native (TP53 R248W)
SCMGGMNWRPILTIITLED

SEQ ID NO: 25079 - protein, 20 aa, Homo sapiens
  Native (TP53 R248W)
SCMGGMNWRPILTIITLEDS

SEQ ID NO: 25080 - protein, 21 aa, Homo sapiens
  Native (TP53 R248W)
SCMGGMNWRPILTIITLEDSS

SEQ ID NO: 25081 - protein, 22 aa, Homo sapiens
  Native (TP53 R248W)
SCMGGMNWRPILTIITLEDSSG

SEQ ID NO: 25082 - protein, 23 aa, Homo sapiens
  Native (TP53 R248W)
SCMGGMNWRPILTIITLEDSSGN

SEQ ID NO: 25083 - protein, 24 aa, Homo sapiens
  Native (TP53 R248W)
SCMGGMNWRPILTIITLEDSSGNL

SEQ ID NO: 25084 - protein, 25 aa, Homo sapiens
  Native (TP53 R248W)
SCMGGMNWRPILTIITLEDSSGNLL

SEQ ID NO: 25085 - protein, 15 aa, Homo sapiens
  Native (TP53 R248W)
SSCMGGMNWRPILTI

SEQ ID NO: 25086 - protein, 16 aa, Homo sapiens
  Native (TP53 R248W)
SSCMGGMNWRPILTII

SEQ ID NO: 25087 - protein, 17 aa, Homo sapiens
  Native (TP53 R248W)
SSCMGGMNWRPILTIIT

SEQ ID NO: 25088 - protein, 18 aa, Homo sapiens
  Native (TP53 R248W)
SSCMGGMNWRPILTIITL

SEQ ID NO: 25089 - protein, 19 aa, Homo sapiens
  Native (TP53 R248W)
SSCMGGMNWRPILTIITLE

SEQ ID NO: 25090 - protein, 20 aa, Homo sapiens
  Native (TP53 R248W)
SSCMGGMNWRPILTIITLED

SEQ ID NO: 25091 - protein, 21 aa, Homo sapiens
  Native (TP53 R248W)
SSCMGGMNWRPILTIITLEDS

SEQ ID NO: 25092 - protein, 22 aa, Homo sapiens
  Native (TP53 R248W)
SSCMGGMNWRPILTIITLEDSS

SEQ ID NO: 25093 - protein, 23 aa, Homo sapiens
  Native (TP53 R248W)
SSCMGGMNWRPILTIITLEDSSG

SEQ ID NO: 25094 - protein, 24 aa, Homo sapiens
  Native (TP53 R248W)
SSCMGGMNWRPILTIITLEDSSGN

SEQ ID NO: 25095 - protein, 25 aa, Homo sapiens
  Native (TP53 R248W)
SSCMGGMNWRPILTIITLEDSSGNL

SEQ ID NO: 25096 - protein, 25 aa, Homo sapiens
  Native (TP53 R248W)
TIHYNYMCNSSCMGGMNWRPILTII

SEQ ID NO: 25097 - protein, 19 aa, Homo sapiens
  Native (TP53 R248W)
YMCNSSCMGGMNWRPILTI

SEQ ID NO: 25098 - protein, 20 aa, Homo sapiens
  Native (TP53 R248W)
YMCNSSCMGGMNWRPILTII

SEQ ID NO: 25099 - protein, 21 aa, Homo sapiens
  Native (TP53 R248W)
YMCNSSCMGGMNWRPILTIIT

SEQ ID NO: 25100 - protein, 22 aa, Homo sapiens
  Native (TP53 R248W)
YMCNSSCMGGMNWRPILTIITL

SEQ ID NO: 25101 - protein, 23 aa, Homo sapiens
  Native (TP53 R248W)
YMCNSSCMGGMNWRPILTIITLE

SEQ ID NO: 25102 - protein, 24 aa, Homo sapiens
  Native (TP53 R248W)
YMCNSSCMGGMNWRPILTIITLED

SEQ ID NO: 25103 - protein, 25 aa, Homo sapiens
  Native (TP53 R248W)
YMCNSSCMGGMNWRPILTIITLEDS

SEQ ID NO: 25104 - protein, 21 aa, Homo sapiens
  Native (TP53 R248W)
YNYMCNSSCMGGMNWRPILTI

SEQ ID NO: 25105 - protein, 22 aa, Homo sapiens
  Native (TP53 R248W)
YNYMCNSSCMGGMNWRPILTII

SEQ ID NO: 25106 - protein, 23 aa, Homo sapiens
  Native (TP53 R248W)
YNYMCNSSCMGGMNWRPILTIIT

SEQ ID NO: 25107 - protein, 24 aa, Homo sapiens
  Native (TP53 R248W)
YNYMCNSSCMGGMNWRPILTIITL

SEQ ID NO: 25108 - protein, 25 aa, Homo sapiens
  Native (TP53 R248W)
YNYMCNSSCMGGMNWRPILTIITLE

SEQ ID NO: 25109 - protein, 20 aa, Homo sapiens
  Native (TP53 R273C)
DSSGNLLGRNSFEVCVCACP

SEQ ID NO: 25110 - protein, 20 aa, Homo sapiens
  Native (TP53 R273C)
EDSSGNLLGRNSFEVCVCAC

SEQ ID NO: 25111 - protein, 20 aa, Homo sapiens
  Native (TP53 R273C)
LEDSSGNLLGRNSFEVCVCA

SEQ ID NO: 25112 - protein, 15 aa, Homo sapiens
  Native (TP53 R273C)
LLGRNSFEVCVCACP

SEQ ID NO: 25113 - protein, 16 aa, Homo sapiens
  Native (TP53 R273C)
NLLGRNSFEVCVCACP

SEQ ID NO: 25114 - protein, 15 aa, Homo sapiens
  Native (TP53 R273C)
SFEVCVCACPGRDRR

SEQ ID NO: 25115 - protein, 20 aa, Homo sapiens
  Native (TP53 R273C)
SGNLLGRNSFEVCVCACPGR

SEQ ID NO: 25116 - protein, 20 aa, Homo sapiens
  Native (TP53 R273C)
SSGNLLGRNSFEVCVCACPG

SEQ ID NO: 25117 - protein, 20 aa, Homo sapiens
  Native (TP53 R273C)
TLEDSSGNLLGRNSFEVCVC

SEQ ID NO: 25118 - protein, 18 aa, Homo sapiens
  Native (TP53 R273H)
DSSGNLLGRNSFEVHVCA

SEQ ID NO: 25119 - protein, 20 aa, Homo sapiens
  Native (TP53 R273H)
DSSGNLLGRNSFEVHVCACP

SEQ ID NO: 25120 - protein, 21 aa, Homo sapiens
  Native (TP53 R273H)
DSSGNLLGRNSFEVHVCACPG

SEQ ID NO: 25121 - protein, 22 aa, Homo sapiens
  Native (TP53 R273H)
DSSGNLLGRNSFEVHVCACPGR

SEQ ID NO: 25122 - protein, 23 aa, Homo sapiens
  Native (TP53 R273H)
DSSGNLLGRNSFEVHVCACPGRD

SEQ ID NO: 25123 - protein, 24 aa, Homo sapiens
  Native (TP53 R273H)
DSSGNLLGRNSFEVHVCACPGRDR

SEQ ID NO: 25124 - protein, 25 aa, Homo sapiens
  Native (TP53 R273H)
DSSGNLLGRNSFEVHVCACPGRDRR

SEQ ID NO: 25125 - protein, 19 aa, Homo sapiens
  Native (TP53 R273H)
EDSSGNLLGRNSFEVHVCA

SEQ ID NO: 25126 - protein, 20 aa, Homo sapiens
  Native (TP53 R273H)
EDSSGNLLGRNSFEVHVCAC

SEQ ID NO: 25127 - protein, 21 aa, Homo sapiens
  Native (TP53 R273H)
EDSSGNLLGRNSFEVHVCACP

SEQ ID NO: 25128 - protein, 22 aa, Homo sapiens
  Native (TP53 R273H)
EDSSGNLLGRNSFEVHVCACPG

SEQ ID NO: 25129 - protein, 23 aa, Homo sapiens
  Native (TP53 R273H)
EDSSGNLLGRNSFEVHVCACPGR

SEQ ID NO: 25130 - protein, 24 aa, Homo sapiens
  Native (TP53 R273H)
EDSSGNLLGRNSFEVHVCACPGRD

SEQ ID NO: 25131 - protein, 25 aa, Homo sapiens
  Native (TP53 R273H)
EDSSGNLLGRNSFEVHVCACPGRDR

SEQ ID NO: 25132 - protein, 15 aa, Homo sapiens
  Native (TP53 R273H)
FEVHVCACPGRDRRT

SEQ ID NO: 25133 - protein, 14 aa, Homo sapiens
  Native (TP53 R273H)
GNLLGRNSFEVHVC

SEQ ID NO: 25134 - protein, 15 aa, Homo sapiens
  Native (TP53 R273H)
GNLLGRNSFEVHVCA

SEQ ID NO: 25135 - protein, 16 aa, Homo sapiens
  Native (TP53 R273H)
GNLLGRNSFEVHVCAC

SEQ ID NO: 25136 - protein, 17 aa, Homo sapiens
  Native (TP53 R273H)
GNLLGRNSFEVHVCACP

SEQ ID NO: 25137 - protein, 18 aa, Homo sapiens
  Native (TP53 R273H)
GNLLGRNSFEVHVCACPG

SEQ ID NO: 25138 - protein, 19 aa, Homo sapiens
  Native (TP53 R273H)
GNLLGRNSFEVHVCACPGR

SEQ ID NO: 25139 - protein, 20 aa, Homo sapiens
  Native (TP53 R273H)
GNLLGRNSFEVHVCACPGRD

SEQ ID NO: 25140 - protein, 23 aa, Homo sapiens
  Native (TP53 R273H)
GNLLGRNSFEVHVCACPGRDRRT

SEQ ID NO: 25141 - protein, 24 aa, Homo sapiens
  Native (TP53 R273H)
GNLLGRNSFEVHVCACPGRDRRTE

SEQ ID NO: 25142 - protein, 25 aa, Homo sapiens
  Native (TP53 R273H)
GNLLGRNSFEVHVCACPGRDRRTEE

SEQ ID NO: 25143 - protein, 15 aa, Homo sapiens
  Native (TP53 R273H)
GRNSFEVHVCACPGR

SEQ ID NO: 25144 - protein, 16 aa, Homo sapiens
  Native (TP53 R273H)
GRNSFEVHVCACPGRD

SEQ ID NO: 25145 - protein, 20 aa, Homo sapiens
  Native (TP53 R273H)
GRNSFEVHVCACPGRDRRTE

SEQ ID NO: 25146 - protein, 22 aa, Homo sapiens
  Native (TP53 R273H)
IITLEDSSGNLLGRNSFEVHVC

SEQ ID NO: 25147 - protein, 23 aa, Homo sapiens
  Native (TP53 R273H)
IITLEDSSGNLLGRNSFEVHVCA

SEQ ID NO: 25148 - protein, 24 aa, Homo sapiens
  Native (TP53 R273H)
IITLEDSSGNLLGRNSFEVHVCAC

SEQ ID NO: 25149 - protein, 25 aa, Homo sapiens
  Native (TP53 R273H)
IITLEDSSGNLLGRNSFEVHVCACP

SEQ ID NO: 25150 - protein, 22 aa, Homo sapiens
  Native (TP53 R273H)
ITLEDSSGNLLGRNSFEVHVCA

SEQ ID NO: 25151 - protein, 23 aa, Homo sapiens
  Native (TP53 R273H)
ITLEDSSGNLLGRNSFEVHVCAC

SEQ ID NO: 25152 - protein, 24 aa, Homo sapiens
  Native (TP53 R273H)
ITLEDSSGNLLGRNSFEVHVCACP

SEQ ID NO: 25153 - protein, 25 aa, Homo sapiens
  Native (TP53 R273H)
ITLEDSSGNLLGRNSFEVHVCACPG

SEQ ID NO: 25154 - protein, 20 aa, Homo sapiens
  Native (TP53 R273H)
LEDSSGNLLGRNSFEVHVCA

SEQ ID NO: 25155 - protein, 22 aa, Homo sapiens
  Native (TP53 R273H)
LEDSSGNLLGRNSFEVHVCACP

SEQ ID NO: 25156 - protein, 23 aa, Homo sapiens
  Native (TP53 R273H)
LEDSSGNLLGRNSFEVHVCACPG

SEQ ID NO: 25157 - protein, 24 aa, Homo sapiens
  Native (TP53 R273H)
LEDSSGNLLGRNSFEVHVCACPGR

SEQ ID NO: 25158 - protein, 25 aa, Homo sapiens
  Native (TP53 R273H)
LEDSSGNLLGRNSFEVHVCACPGRD

SEQ ID NO: 25159 - protein, 15 aa, Homo sapiens
  Native (TP53 R273H)
LGRNSFEVHVCACPG

SEQ ID NO: 25160 - protein, 16 aa, Homo sapiens
  Native (TP53 R273H)
LGRNSFEVHVCACPGR

SEQ ID NO: 25161 - protein, 20 aa, Homo sapiens
  Native (TP53 R273H)
LGRNSFEVHVCACPGRDRRT

SEQ ID NO: 25162 - protein, 14 aa, Homo sapiens
  Native (TP53 R273H)
LLGRNSFEVHVCAC

SEQ ID NO: 25163 - protein, 15 aa, Homo sapiens
  Native (TP53 R273H)
LLGRNSFEVHVCACP

SEQ ID NO: 25164 - protein, 16 aa, Homo sapiens
  Native (TP53 R273H)
LLGRNSFEVHVCACPG

SEQ ID NO: 25165 - protein, 17 aa, Homo sapiens
  Native (TP53 R273H)
LLGRNSFEVHVCACPGR

SEQ ID NO: 25166 - protein, 20 aa, Homo sapiens
  Native (TP53 R273H)
LLGRNSFEVHVCACPGRDRR

SEQ ID NO: 25167 - protein, 14 aa, Homo sapiens
  Native (TP53 R273H)
NLLGRNSFEVHVCA

SEQ ID NO: 25168 - protein, 15 aa, Homo sapiens
  Native (TP53 R273H)
NLLGRNSFEVHVCAC

SEQ ID NO: 25169 - protein, 16 aa, Homo sapiens
  Native (TP53 R273H)
NLLGRNSFEVHVCACP

SEQ ID NO: 25170 - protein, 17 aa, Homo sapiens
  Native (TP53 R273H)
NLLGRNSFEVHVCACPG

SEQ ID NO: 25171 - protein, 19 aa, Homo sapiens
  Native (TP53 R273H)
NLLGRNSFEVHVCACPGRD

SEQ ID NO: 25172 - protein, 20 aa, Homo sapiens
  Native (TP53 R273H)
NLLGRNSFEVHVCACPGRDR

SEQ ID NO: 25173 - protein, 24 aa, Homo sapiens
  Native (TP53 R273H)
NLLGRNSFEVHVCACPGRDRRTEE

SEQ ID NO: 25174 - protein, 25 aa, Homo sapiens
  Native (TP53 R273H)
NLLGRNSFEVHVCACPGRDRRTEEE

SEQ ID NO: 25175 - protein, 15 aa, Homo sapiens
  Native (TP53 R273H)
NSFEVHVCACPGRDR

SEQ ID NO: 25176 - protein, 16 aa, Homo sapiens
  Native (TP53 R273H)
NSFEVHVCACPGRDRR

SEQ ID NO: 25177 - protein, 20 aa, Homo sapiens
  Native (TP53 R273H)
NSFEVHVCACPGRDRRTEEE

SEQ ID NO: 25178 - protein, 15 aa, Homo sapiens
  Native (TP53 R273H)
RNSFEVHVCACPGRD

SEQ ID NO: 25179 - protein, 16 aa, Homo sapiens
  Native (TP53 R273H)
RNSFEVHVCACPGRDR

SEQ ID NO: 25180 - protein, 17 aa, Homo sapiens
  Native (TP53 R273H)
RNSFEVHVCACPGRDRR

SEQ ID NO: 25181 - protein, 20 aa, Homo sapiens
  Native (TP53 R273H)
RNSFEVHVCACPGRDRRTEE

SEQ ID NO: 25182 - protein, 15 aa, Homo sapiens
  Native (TP53 R273H)
SFEVHVCACPGRDRR

SEQ ID NO: 25183 - protein, 16 aa, Homo sapiens
  Native (TP53 R273H)
SFEVHVCACPGRDRRT

SEQ ID NO: 25184 - protein, 16 aa, Homo sapiens
  Native (TP53 R273H)
SGNLLGRNSFEVHVCA

SEQ ID NO: 25185 - protein, 17 aa, Homo sapiens
  Native (TP53 R273H)
SGNLLGRNSFEVHVCAC

SEQ ID NO: 25186 - protein, 18 aa, Homo sapiens
  Native (TP53 R273H)
SGNLLGRNSFEVHVCACP

SEQ ID NO: 25187 - protein, 19 aa, Homo sapiens
  Native (TP53 R273H)
SGNLLGRNSFEVHVCACPG

SEQ ID NO: 25188 - protein, 20 aa, Homo sapiens
  Native (TP53 R273H)
SGNLLGRNSFEVHVCACPGR

SEQ ID NO: 25189 - protein, 21 aa, Homo sapiens
  Native (TP53 R273H)
SGNLLGRNSFEVHVCACPGRD

SEQ ID NO: 25190 - protein, 22 aa, Homo sapiens
  Native (TP53 R273H)
SGNLLGRNSFEVHVCACPGRDR

SEQ ID NO: 25191 - protein, 23 aa, Homo sapiens
  Native (TP53 R273H)
SGNLLGRNSFEVHVCACPGRDRR

SEQ ID NO: 25192 - protein, 24 aa, Homo sapiens
  Native (TP53 R273H)
SGNLLGRNSFEVHVCACPGRDRRT

SEQ ID NO: 25193 - protein, 25 aa, Homo sapiens
  Native (TP53 R273H)
SGNLLGRNSFEVHVCACPGRDRRTE

SEQ ID NO: 25194 - protein, 17 aa, Homo sapiens
  Native (TP53 R273H)
SSGNLLGRNSFEVHVCA

SEQ ID NO: 25195 - protein, 19 aa, Homo sapiens
  Native (TP53 R273H)
SSGNLLGRNSFEVHVCACP

SEQ ID NO: 25196 - protein, 20 aa, Homo sapiens
  Native (TP53 R273H)
SSGNLLGRNSFEVHVCACPG

SEQ ID NO: 25197 - protein, 21 aa, Homo sapiens
  Native (TP53 R273H)
SSGNLLGRNSFEVHVCACPGR

SEQ ID NO: 25198 - protein, 22 aa, Homo sapiens
  Native (TP53 R273H)
SSGNLLGRNSFEVHVCACPGRD

SEQ ID NO: 25199 - protein, 23 aa, Homo sapiens
  Native (TP53 R273H)
SSGNLLGRNSFEVHVCACPGRDR

SEQ ID NO: 25200 - protein, 24 aa, Homo sapiens
  Native (TP53 R273H)
SSGNLLGRNSFEVHVCACPGRDRR

SEQ ID NO: 25201 - protein, 25 aa, Homo sapiens
  Native (TP53 R273H)
SSGNLLGRNSFEVHVCACPGRDRRT

SEQ ID NO: 25202 - protein, 20 aa, Homo sapiens
  Native (TP53 R273H)
TLEDSSGNLLGRNSFEVHVC

SEQ ID NO: 25203 - protein, 21 aa, Homo sapiens
  Native (TP53 R273H)
TLEDSSGNLLGRNSFEVHVCA

SEQ ID NO: 25204 - protein, 23 aa, Homo sapiens
  Native (TP53 R273H)
TLEDSSGNLLGRNSFEVHVCACP

SEQ ID NO: 25205 - protein, 24 aa, Homo sapiens
  Native (TP53 R273H)
TLEDSSGNLLGRNSFEVHVCACPG

SEQ ID NO: 25206 - protein, 25 aa, Homo sapiens
  Native (TP53 R273H)
TLEDSSGNLLGRNSFEVHVCACPGR

SEQ ID NO: 25207 - protein, 15 aa, Homo sapiens
  Native (TP53 R282W)
EVRVCACPGRDWRTE

SEQ ID NO: 25208 - protein, 16 aa, Homo sapiens
  Native (TP53 R282W)
EVRVCACPGRDWRTEE

SEQ ID NO: 25209 - protein, 17 aa, Homo sapiens
  Native (TP53 R282W)
FEVRVCACPGRDWRTEE

SEQ ID NO: 25210 - protein, 19 aa, Homo sapiens
  Native (TP53 R282W)
FEVRVCACPGRDWRTEEEN

SEQ ID NO: 25211 - protein, 20 aa, Homo sapiens
  Native (TP53 R282W)
FEVRVCACPGRDWRTEEENL

SEQ ID NO: 25212 - protein, 20 aa, Homo sapiens
  Native (TP53 R282W)
NSFEVRVCACPGRDWRTEEE

SEQ ID NO: 25213 - protein, 21 aa, Homo sapiens
  Native (TP53 R282W)
NSFEVRVCACPGRDWRTEEEN

SEQ ID NO: 25214 - protein, 22 aa, Homo sapiens
  Native (TP53 R282W)
NSFEVRVCACPGRDWRTEEENL

SEQ ID NO: 25215 - protein, 22 aa, Homo sapiens
  Native (TP53 R282W)
RNSFEVRVCACPGRDWRTEEEN

SEQ ID NO: 25216 - protein, 23 aa, Homo sapiens
  Native (TP53 R282W)
RNSFEVRVCACPGRDWRTEEENL

SEQ ID NO: 25217 - protein, 19 aa, Homo sapiens
  Native (TP53 R282W)
SFEVRVCACPGRDWRTEEE

SEQ ID NO: 25218 - protein, 20 aa, Homo sapiens
  Native (TP53 R282W)
SFEVRVCACPGRDWRTEEEN

SEQ ID NO: 25219 - protein, 17 aa, Homo sapiens
  Native (TP53 Y220C)
DDRNTFRHSVVVPCEPP

SEQ ID NO: 25220 - protein, 19 aa, Homo sapiens
  Native (TP53 Y220C)
DDRNTFRHSVVVPCEPPEV

SEQ ID NO: 25221 - protein, 20 aa, Homo sapiens
  Native (TP53 Y220C)
DDRNTFRHSVVVPCEPPEVG

SEQ ID NO: 25222 - protein, 21 aa, Homo sapiens
  Native (TP53 Y220C)
DDRNTFRHSVVVPCEPPEVGS

SEQ ID NO: 25223 - protein, 22 aa, Homo sapiens
  Native (TP53 Y220C)
DDRNTFRHSVVVPCEPPEVGSD

SEQ ID NO: 25224 - protein, 23 aa, Homo sapiens
  Native (TP53 Y220C)
DDRNTFRHSVVVPCEPPEVGSDC

SEQ ID NO: 25225 - protein, 24 aa, Homo sapiens
  Native (TP53 Y220C)
DDRNTFRHSVVVPCEPPEVGSDCT

SEQ ID NO: 25226 - protein, 25 aa, Homo sapiens
  Native (TP53 Y220C)
DDRNTFRHSVVVPCEPPEVGSDCTT

SEQ ID NO: 25227 - protein, 15 aa, Homo sapiens
  Native (TP53 Y220C)
DRNTFRHSVVVPCEP

SEQ ID NO: 25228 - protein, 16 aa, Homo sapiens
  Native (TP53 Y220C)
DRNTFRHSVVVPCEPP

SEQ ID NO: 25229 - protein, 17 aa, Homo sapiens
  Native (TP53 Y220C)
DRNTFRHSVVVPCEPPE

SEQ ID NO: 25230 - protein, 19 aa, Homo sapiens
  Native (TP53 Y220C)
DRNTFRHSVVVPCEPPEVG

SEQ ID NO: 25231 - protein, 20 aa, Homo sapiens
  Native (TP53 Y220C)
DRNTFRHSVVVPCEPPEVGS

SEQ ID NO: 25232 - protein, 21 aa, Homo sapiens
  Native (TP53 Y220C)
DRNTFRHSVVVPCEPPEVGSD

SEQ ID NO: 25233 - protein, 22 aa, Homo sapiens
  Native (TP53 Y220C)
DRNTFRHSVVVPCEPPEVGSDC

SEQ ID NO: 25234 - protein, 23 aa, Homo sapiens
  Native (TP53 Y220C)
DRNTFRHSVVVPCEPPEVGSDCT

SEQ ID NO: 25235 - protein, 24 aa, Homo sapiens
  Native (TP53 Y220C)
DRNTFRHSVVVPCEPPEVGSDCTT

SEQ ID NO: 25236 - protein, 25 aa, Homo sapiens
  Native (TP53 Y220C)
DRNTFRHSVVVPCEPPEVGSDCTTI

SEQ ID NO: 25237 - protein, 20 aa, Homo sapiens
  Native (TP53 Y220C)
EYLDDRNTFRHSVVVPCEPP

SEQ ID NO: 25238 - protein, 21 aa, Homo sapiens
  Native (TP53 Y220C)
EYLDDRNTFRHSVVVPCEPPE

SEQ ID NO: 25239 - protein, 22 aa, Homo sapiens
  Native (TP53 Y220C)
EYLDDRNTFRHSVVVPCEPPEV

SEQ ID NO: 25240 - protein, 23 aa, Homo sapiens
  Native (TP53 Y220C)
EYLDDRNTFRHSVVVPCEPPEVG

SEQ ID NO: 25241 - protein, 24 aa, Homo sapiens
  Native (TP53 Y220C)
EYLDDRNTFRHSVVVPCEPPEVGS

SEQ ID NO: 25242 - protein, 25 aa, Homo sapiens
  Native (TP53 Y220C)
EYLDDRNTFRHSVVVPCEPPEVGSD

SEQ ID NO: 25243 - protein, 14 aa, Homo sapiens
  Native (TP53 Y220C)
FRHSVVVPCEPPEV

SEQ ID NO: 25244 - protein, 15 aa, Homo sapiens
  Native (TP53 Y220C)
FRHSVVVPCEPPEVG

SEQ ID NO: 25245 - protein, 16 aa, Homo sapiens
  Native (TP53 Y220C)
FRHSVVVPCEPPEVGS

SEQ ID NO: 25246 - protein, 25 aa, Homo sapiens
  Native (TP53 Y220C)
GNLRVEYLDDRNTFRHSVVVPCEPP

SEQ ID NO: 25247 - protein, 19 aa, Homo sapiens
  Native (TP53 Y220C)
LDDRNTFRHSVVVPCEPPE

SEQ ID NO: 25248 - protein, 20 aa, Homo sapiens
  Native (TP53 Y220C)
LDDRNTFRHSVVVPCEPPEV

SEQ ID NO: 25249 - protein, 21 aa, Homo sapiens
  Native (TP53 Y220C)
LDDRNTFRHSVVVPCEPPEVG

SEQ ID NO: 25250 - protein, 22 aa, Homo sapiens
  Native (TP53 Y220C)
LDDRNTFRHSVVVPCEPPEVGS

SEQ ID NO: 25251 - protein, 23 aa, Homo sapiens
  Native (TP53 Y220C)
LDDRNTFRHSVVVPCEPPEVGSD

SEQ ID NO: 25252 - protein, 24 aa, Homo sapiens
  Native (TP53 Y220C)
LDDRNTFRHSVVVPCEPPEVGSDC

SEQ ID NO: 25253 - protein, 25 aa, Homo sapiens
  Native (TP53 Y220C)
LDDRNTFRHSVVVPCEPPEVGSDCT

SEQ ID NO: 25254 - protein, 24 aa, Homo sapiens
  Native (TP53 Y220C)
LRVEYLDDRNTFRHSVVVPCEPPE

SEQ ID NO: 25255 - protein, 25 aa, Homo sapiens
  Native (TP53 Y220C)
LRVEYLDDRNTFRHSVVVPCEPPEV

SEQ ID NO: 25256 - protein, 25 aa, Homo sapiens
  Native (TP53 Y220C)
NLRVEYLDDRNTFRHSVVVPCEPPE

SEQ ID NO: 25257 - protein, 13 aa, Homo sapiens
  Native (TP53 Y220C)
NTFRHSVVVPCEP

SEQ ID NO: 25258 - protein, 14 aa, Homo sapiens
  Native (TP53 Y220C)
NTFRHSVVVPCEPP

SEQ ID NO: 25259 - protein, 15 aa, Homo sapiens
  Native (TP53 Y220C)
NTFRHSVVVPCEPPE

SEQ ID NO: 25260 - protein, 16 aa, Homo sapiens
  Native (TP53 Y220C)
NTFRHSVVVPCEPPEV

SEQ ID NO: 25261 - protein, 17 aa, Homo sapiens
  Native (TP53 Y220C)
NTFRHSVVVPCEPPEVG

SEQ ID NO: 25262 - protein, 18 aa, Homo sapiens
  Native (TP53 Y220C)
NTFRHSVVVPCEPPEVGS

SEQ ID NO: 25263 - protein, 19 aa, Homo sapiens
  Native (TP53 Y220C)
NTFRHSVVVPCEPPEVGSD

SEQ ID NO: 25264 - protein, 20 aa, Homo sapiens
  Native (TP53 Y220C)
NTFRHSVVVPCEPPEVGSDC

SEQ ID NO: 25265 - protein, 21 aa, Homo sapiens
  Native (TP53 Y220C)
NTFRHSVVVPCEPPEVGSDCT

SEQ ID NO: 25266 - protein, 22 aa, Homo sapiens
  Native (TP53 Y220C)
NTFRHSVVVPCEPPEVGSDCTT

SEQ ID NO: 25267 - protein, 23 aa, Homo sapiens
  Native (TP53 Y220C)
NTFRHSVVVPCEPPEVGSDCTTI

SEQ ID NO: 25268 - protein, 24 aa, Homo sapiens
  Native (TP53 Y220C)
NTFRHSVVVPCEPPEVGSDCTTIH

SEQ ID NO: 25269 - protein, 25 aa, Homo sapiens
  Native (TP53 Y220C)
NTFRHSVVVPCEPPEVGSDCTTIHY

SEQ ID NO: 25270 - protein, 15 aa, Homo sapiens
  Native (TP53 Y220C)
RNTFRHSVVVPCEPP

SEQ ID NO: 25271 - protein, 16 aa, Homo sapiens
  Native (TP53 Y220C)
RNTFRHSVVVPCEPPE

SEQ ID NO: 25272 - protein, 17 aa, Homo sapiens
  Native (TP53 Y220C)
RNTFRHSVVVPCEPPEV

SEQ ID NO: 25273 - protein, 19 aa, Homo sapiens
  Native (TP53 Y220C)
RNTFRHSVVVPCEPPEVGS

SEQ ID NO: 25274 - protein, 20 aa, Homo sapiens
  Native (TP53 Y220C)
RNTFRHSVVVPCEPPEVGSD

SEQ ID NO: 25275 - protein, 22 aa, Homo sapiens
  Native (TP53 Y220C)
RNTFRHSVVVPCEPPEVGSDCT

SEQ ID NO: 25276 - protein, 23 aa, Homo sapiens
  Native (TP53 Y220C)
RNTFRHSVVVPCEPPEVGSDCTT

SEQ ID NO: 25277 - protein, 24 aa, Homo sapiens
  Native (TP53 Y220C)
RNTFRHSVVVPCEPPEVGSDCTTI

SEQ ID NO: 25278 - protein, 25 aa, Homo sapiens
  Native (TP53 Y220C)
RNTFRHSVVVPCEPPEVGSDCTTIH

SEQ ID NO: 25279 - protein, 23 aa, Homo sapiens
  Native (TP53 Y220C)
RVEYLDDRNTFRHSVVVPCEPPE

SEQ ID NO: 25280 - protein, 24 aa, Homo sapiens
  Native (TP53 Y220C)
RVEYLDDRNTFRHSVVVPCEPPEV

SEQ ID NO: 25281 - protein, 25 aa, Homo sapiens
  Native (TP53 Y220C)
RVEYLDDRNTFRHSVVVPCEPPEVG

SEQ ID NO: 25282 - protein, 13 aa, Homo sapiens
  Native (TP53 Y220C)
TFRHSVVVPCEPP

SEQ ID NO: 25283 - protein, 14 aa, Homo sapiens
  Native (TP53 Y220C)
TFRHSVVVPCEPPE

SEQ ID NO: 25284 - protein, 15 aa, Homo sapiens
  Native (TP53 Y220C)
TFRHSVVVPCEPPEV

SEQ ID NO: 25285 - protein, 16 aa, Homo sapiens
  Native (TP53 Y220C)
TFRHSVVVPCEPPEVG

SEQ ID NO: 25286 - protein, 17 aa, Homo sapiens
  Native (TP53 Y220C)
TFRHSVVVPCEPPEVGS

SEQ ID NO: 25287 - protein, 19 aa, Homo sapiens
  Native (TP53 Y220C)
TFRHSVVVPCEPPEVGSDC

SEQ ID NO: 25288 - protein, 20 aa, Homo sapiens
  Native (TP53 Y220C)
TFRHSVVVPCEPPEVGSDCT

SEQ ID NO: 25289 - protein, 21 aa, Homo sapiens
  Native (TP53 Y220C)
TFRHSVVVPCEPPEVGSDCTT

SEQ ID NO: 25290 - protein, 22 aa, Homo sapiens
  Native (TP53 Y220C)
TFRHSVVVPCEPPEVGSDCTTI

SEQ ID NO: 25291 - protein, 23 aa, Homo sapiens
  Native (TP53 Y220C)
TFRHSVVVPCEPPEVGSDCTTIH

SEQ ID NO: 25292 - protein, 24 aa, Homo sapiens
  Native (TP53 Y220C)
TFRHSVVVPCEPPEVGSDCTTIHY

SEQ ID NO: 25293 - protein, 25 aa, Homo sapiens
  Native (TP53 Y220C)
TFRHSVVVPCEPPEVGSDCTTIHYN

SEQ ID NO: 25294 - protein, 22 aa, Homo sapiens
  Native (TP53 Y220C)
VEYLDDRNTFRHSVVVPCEPPE

SEQ ID NO: 25295 - protein, 23 aa, Homo sapiens
  Native (TP53 Y220C)
VEYLDDRNTFRHSVVVPCEPPEV

SEQ ID NO: 25296 - protein, 24 aa, Homo sapiens
  Native (TP53 Y220C)
VEYLDDRNTFRHSVVVPCEPPEVG

SEQ ID NO: 25297 - protein, 25 aa, Homo sapiens
  Native (TP53 Y220C)
VEYLDDRNTFRHSVVVPCEPPEVGS

SEQ ID NO: 25298 - protein, 19 aa, Homo sapiens
  Native (TP53 Y220C)
YLDDRNTFRHSVVVPCEPP

SEQ ID NO: 25299 - protein, 20 aa, Homo sapiens
  Native (TP53 Y220C)
YLDDRNTFRHSVVVPCEPPE

SEQ ID NO: 25300 - protein, 21 aa, Homo sapiens
  Native (TP53 Y220C)
YLDDRNTFRHSVVVPCEPPEV

SEQ ID NO: 25301 - protein, 22 aa, Homo sapiens
  Native (TP53 Y220C)
YLDDRNTFRHSVVVPCEPPEVG

SEQ ID NO: 25302 - protein, 23 aa, Homo sapiens
  Native (TP53 Y220C)
YLDDRNTFRHSVVVPCEPPEVGS

SEQ ID NO: 25303 - protein, 24 aa, Homo sapiens
  Native (TP53 Y220C)
YLDDRNTFRHSVVVPCEPPEVGSD

SEQ ID NO: 25304 - protein, 25 aa, Homo sapiens
  Native (TP53 Y220C)
YLDDRNTFRHSVVVPCEPPEVGSDC

SEQ ID NO: 25305 - protein, 15 aa, Artificial Sequence
  Description of Artificial Sequence: Synthetic peptide
  Seed: AIVKEGWLHKRGKYI (AKT1 E17K)
  Core: GWLHKRGKY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEXWLXKXGKXI

SEQ ID NO: 25306 - protein, 15 aa, Artificial Sequence
  Description of Artificial Sequence: Synthetic peptide
  Seed: AIVKEGWLHKRGKYI (AKT1 E17K)
  Core: WLHKRGKYI
  misc_feature (7)..(7): Xaa can be Ala, Cys, Asp, Glu, Phe, Gly, His, Ile, Lys, Leu, Met, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGXLHXRXKYX

SEQ ID NO: 25307 - protein, 16 aa, Artificial Sequence
  Description of Artificial Sequence: Synthetic peptide
  Seed: AIVKEGWLHKRGKYIK (AKT1 E17K)
  Core: GWLHKRGKY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEXWLXKXGKXIK

SEQ ID NO: 25308 - protein, 16 aa, Artificial Sequence
  Description of Artificial Sequence: Synthetic peptide
  Seed: AIVKEGWLHKRGKYIK (AKT1 E17K)
  Core: WLHKRGKYI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGXLHXRXKYXK

SEQ ID NO: 25309 - protein, 17 aa, Artificial Sequence
  Description of Artificial Sequence: Synthetic peptide
  Seed: AIVKEGWLHKRGKYIKT (AKT1 E17K)
  Core: GWLHKRGKY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEXWLXKXGKXIKT

SEQ ID NO: 25310 - protein, 17 aa, Artificial Sequence
  Description of Artificial Sequence: Synthetic peptide
  Seed: AIVKEGWLHKRGKYIKT (AKT1 E17K)
  Core: WLHKRGKYI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGXLHXRXKYXKT

SEQ ID NO: 25311 - protein, 19 aa, Artificial Sequence
  Description of Artificial Sequence: Synthetic peptide
  Seed: AIVKEGWLHKRGKYIKTWR (AKT1 E17K)
  Core: WLHKRGKYI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGXLHXRXKYXKTWR

SEQ ID NO: 25312 - protein, 20 aa, Artificial Sequence
  Description of Artificial Sequence: Synthetic peptide
  Seed: AIVKEGWLHKRGKYIKTWRP (AKT1 E17K)
  Core: WLHKRGKYI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGXLHXRXKYXKTWRP

SEQ ID NO: 25313 - protein, 21 aa, Artificial Sequence
  Description of Artificial Sequence: Synthetic peptide
  Seed: AIVKEGWLHKRGKYIKTWRPR (AKT1 E17K)
  Core: WLHKRGKYI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGXLHXRXKYXKTWRPR

SEQ ID NO: 25314 - protein, 22 aa, Artificial Sequence
  Description of Artificial Sequence: Synthetic peptide
  Seed: AIVKEGWLHKRGKYIKTWRPRY (AKT1 E17K)
  Core: WLHKRGKYI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGXLHXRXKYXKTWRPRY

SEQ ID NO: 25315 - protein, 22 aa, Artificial Sequence
  Description of Artificial Sequence: Synthetic peptide
  Seed: AIVKEGWLHKRGKYIKTWRPRY (AKT1 E17K)
  Core: GKYIKTWRP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGWLHKRXKYXKXWRXRY

SEQ ID NO: 25316 - protein, 23 aa, Artificial Sequence
  Description of Artificial Sequence: Synthetic peptide
  Seed: AIVKEGWLHKRGKYIKTWRPRYF (AKT1 E17K)
  Core: WLHKRGKYI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGXLHXRXKYXKTWRPRYF

SEQ ID NO: 25317 - protein, 23 aa, Artificial Sequence
  Description of Artificial Sequence: Synthetic peptide
  Seed: AIVKEGWLHKRGKYIKTWRPRYF (AKT1 E17K)
  Core: GKYIKTWRP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGWLHKRXKYXKXWRXRYF

SEQ ID NO: 25318 - protein, 24 aa, Artificial Sequence
  Description of Artificial Sequence: Synthetic peptide
  Seed: AIVKEGWLHKRGKYIKTWRPRYFL (AKT1 E17K)
  Core: WLHKRGKYI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGXLHXRXKYXKTWRPRYFL

SEQ ID NO: 25319 - protein, 24 aa, Artificial Sequence
  Description of Artificial Sequence: Synthetic peptide
  Seed: AIVKEGWLHKRGKYIKTWRPRYFL (AKT1 E17K)
  Core: HKRGKYIKT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGWLXKRXKXIKXWRPRYFL

SEQ ID NO: 25320 - protein, 24 aa, Artificial Sequence
  Description of Artificial Sequence: Synthetic peptide
  Seed: AIVKEGWLHKRGKYIKTWRPRYFL (AKT1 E17K)
  Core: GKYIKTWRP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGWLHKRXKYXKXWRXRYFL

SEQ ID NO: 25321 - protein, 25 aa, Artificial Sequence
  Description of Artificial Sequence: Synthetic peptide
  Seed: AIVKEGWLHKRGKYIKTWRPRYFLL (AKT1 E17K)
  Core: WLHKRGKYI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGXLHXRXKYXKTWRPRYFLL

SEQ ID NO: 25322 - protein, 25 aa, Artificial Sequence
  Description of Artificial Sequence: Synthetic peptide
  Seed: AIVKEGWLHKRGKYIKTWRPRYFLL (AKT1 E17K)
  Core: HKRGKYIKT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGWLXKRXKXIKXWRPRYFLL

SEQ ID NO: 25323 - protein, 25 aa, Artificial Sequence
  Description of Artificial Sequence: Synthetic peptide
  Seed: AIVKEGWLHKRGKYIKTWRPRYFLL (AKT1 E17K)
  Core: GKYIKTWRP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIVKEGWLHKRXKYXKXWRXRYFLL

SEQ ID NO: 25324 - protein, 19 aa, Artificial Sequence
  Description of Artificial Sequence: Synthetic peptide
  Seed: DVAIVKEGWLHKRGKYIKT (AKT1 E17K)
  Core: GWLHKRGKY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DVAIVKEXWLXKXGKXIKT

SEQ ID NO: 25325 - protein, 19 aa, Artificial Sequence
  Description of Artificial Sequence: Synthetic peptide
  Seed: DVAIVKEGWLHKRGKYIKT (AKT1 E17K)
  Core: WLHKRGKYI
  misc_feature (9)..(9): Xaa can be Cys, Glu, Phe, His, Ile, Lys, Leu, Met, Gln, Arg, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DVAIVKEGXLHXRXKYXKT

SEQ ID NO: 25326 - protein, 20 aa, Artificial Sequence
  Description of Artificial Sequence: Synthetic peptide
  Seed: DVAIVKEGWLHKRGKYIKTW (AKT1 E17K)
  Core: GWLHKRGKY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DVAIVKEXWLXKXGKXIKTW

SEQ ID NO: 25327 - protein, 20 aa, Artificial Sequence
  Description of Artificial Sequence: Synthetic peptide
  Seed: DVAIVKEGWLHKRGKYIKTW (AKT1 E17K)
  Core: WLHKRGKYI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DVAIVKEGXLHXRXKYXKTW

SEQ ID NO: 25328 - protein, 21 aa, Artificial Sequence
  Description of Artificial Sequence: Synthetic peptide
  Seed: DVAIVKEGWLHKRGKYIKTWR (AKT1 E17K)
  Core: WLHKRGKYI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DVAIVKEGXLHXRXKYXKTWR

SEQ ID NO: 25329 - protein, 22 aa, Artificial Sequence
  Description of Artificial Sequence: Synthetic peptide
  Seed: DVAIVKEGWLHKRGKYIKTWRP (AKT1 E17K)
  Core: WLHKRGKYI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DVAIVKEGXLHXRXKYXKTWRP

SEQ ID NO: 25330 - protein, 23 aa, Artificial Sequence
  Description of Artificial Sequence: Synthetic peptide
  Seed: DVAIVKEGWLHKRGKYIKTWRPR (AKT1 E17K)
  Core: WLHKRGKYI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DVAIVKEGXLHXRXKYXKTWRPR

SEQ ID NO: 25331 - protein, 24 aa, Artificial Sequence
  Description of Artificial Sequence: Synthetic peptide
  Seed: DVAIVKEGWLHKRGKYIKTWRPRY (AKT1 E17K)
  Core: WLHKRGKYI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DVAIVKEGXLHXRXKYXKTWRPRY

SEQ ID NO: 25332 - protein, 24 aa, Artificial Sequence
  Description of Artificial Sequence: Synthetic peptide
  Seed: DVAIVKEGWLHKRGKYIKTWRPRY (AKT1 E17K)
  Core: GKYIKTWRP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DVAIVKEGWLHKRXKYXKXWRXRY

SEQ ID NO: 25333 - protein, 25 aa, Artificial Sequence
  Description of Artificial Sequence: Synthetic peptide
  Seed: DVAIVKEGWLHKRGKYIKTWRPRYF (AKT1 E17K)
  Core: WLHKRGKYI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DVAIVKEGXLHXRXKYXKTWRPRYF

SEQ ID NO: 25334 - protein, 25 aa, Artificial Sequence
  Description of Artificial Sequence: Synthetic peptide
  Seed: DVAIVKEGWLHKRGKYIKTWRPRYF (AKT1 E17K)
  Core: HKRGKYIKT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DVAIVKEGWLXKRXKXIKXWRPRYF

SEQ ID NO: 25335 - protein, 25 aa, Artificial Sequence
  Description of Artificial Sequence: Synthetic peptide
  Seed: DVAIVKEGWLHKRGKYIKTWRPRYF (AKT1 E17K)
  Core: GKYIKTWRP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DVAIVKEGWLHKRXKYXKXWRXRYF

SEQ ID NO: 25336 - protein, 15 aa, Artificial Sequence
  Description of Artificial Sequence: Synthetic peptide
  Seed: EGWLHKRGKYIKTWR (AKT1 E17K)
  Core: WLHKRGKYI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EGXLHXRXKYXKTWR

SEQ ID NO: 25337 - protein, 16 aa, Artificial Sequence
  Description of Artificial Sequence: Synthetic peptide
  Seed: EGWLHKRGKYIKTWRP (AKT1 E17K)
  Core: WLHKRGKYI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EGXLHXRXKYXKTWRP

SEQ ID NO: 25338 - protein, 17 aa, Artificial Sequence
  Description of Artificial Sequence: Synthetic peptide
  Seed: EGWLHKRGKYIKTWRPR (AKT1 E17K)
  Core: WLHKRGKYI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, or Trp
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EGXLHXRXKYXKTWRPR

SEQ ID NO: 25339 - protein, 17 aa, Artificial Sequence
  Description of Artificial Sequence: Synthetic peptide
  Seed: EGWLHKRGKYIKTWRPR (AKT1 E17K)
  Core: GKYIKTWRP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EGWLHKRXKYXKXWRXR

SEQ ID NO: 25340 - protein, 19 aa, Artificial Sequence
  Description of Artificial Sequence: Synthetic peptide
  Seed: EGWLHKRGKYIKTWRPRYF (AKT1 E17K)
  Core: WLHKRGKYI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EGXLHXRXKYXKTWRPRYF

SEQ ID NO: 25341 - protein, 19 aa, Artificial Sequence
  Description of Artificial Sequence: Synthetic peptide
  Seed: EGWLHKRGKYIKTWRPRYF (AKT1 E17K)
  Core: GKYIKTWRP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EGWLHKRXKYXKXWRXRYF

SEQ ID NO: 25342 - protein, 20 aa, Artificial Sequence
  Description of Artificial Sequence: Synthetic peptide
  Seed: EGWLHKRGKYIKTWRPRYFL (AKT1 E17K)
  Core: WLHKRGKYI
  misc_feature (3)..(3): Xaa can be Ala, Cys, Asp, Glu, Phe, Gly, His, Ile, Lys, Leu, Met, Asn, Pro, Gln, Arg, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EGXLHXRXKYXKTWRPRYFL

SEQ ID NO: 25343 - protein, 20 aa, Artificial Sequence
  Description of Artificial Sequence: Synthetic peptide
  Seed: EGWLHKRGKYIKTWRPRYFL (AKT1 E17K)
  Core: HKRGKYIKT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EGWLXKRXKXIKXWRPRYFL

SEQ ID NO: 25344 - protein, 20 aa, Artificial Sequence
  Description of Artificial Sequence: Synthetic peptide
  Seed: EGWLHKRGKYIKTWRPRYFL (AKT1 E17K)
  Core: GKYIKTWRP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EGWLHKRXKYXKXWRXRYFL

SEQ ID NO: 25345 - protein, 21 aa, Artificial Sequence
  Description of Artificial Sequence: Synthetic peptide
  Seed: EGWLHKRGKYIKTWRPRYFLL (AKT1 E17K)
  Core: WLHKRGKYI
  misc_feature (3)..(3): Xaa can be Ala, Cys, Asp, Glu, Phe, His, Ile, Lys, Leu, Met, Asn, Pro, Gln, Arg, Thr, Val, Trp, or Ty r
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EGXLHXRXKYXKTWRPRYFLL

SEQ ID NO: 25346 - protein, 21 aa, Artificial Sequence
  Description of Artificial Sequence: Synthetic peptide
  Seed: EGWLHKRGKYIKTWRPRYFLL (AKT1 E17K)
  Core: HKRGKYIKT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EGWLXKRXKXIKXWRPRYFLL

SEQ ID NO: 25347 - protein, 21 aa, Artificial Sequence
  Description of Artificial Sequence: Synthetic peptide
  Seed: EGWLHKRGKYIKTWRPRYFLL (AKT1 E17K)
  Core: GKYIKTWRP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EGWLHKRXKYXKXWRXRYFLL

SEQ ID NO: 25348 - protein, 22 aa, Artificial Sequence
  Description of Artificial Sequence: Synthetic peptide
  Seed: EGWLHKRGKYIKTWRPRYFLLK (AKT1 E17K)
  Core: WLHKRGKYI
  misc_feature (3)..(3): Xaa can be Ala, Cys, Asp, Glu, Phe, Gly, His, Ile, Lys, Leu, Met, Asn, Pro, Gln, Arg, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EGXLHXRXKYXKTWRPRYFLLK

SEQ ID NO: 25349 - protein, 22 aa, Artificial Sequence
  Description of Artificial Sequence: Synthetic peptide
  Seed: EGWLHKRGKYIKTWRPRYFLLK (AKT1 E17K)
  Core: GKYIKTWRP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EGWLHKRXKYXKXWRXRYFLLK

SEQ ID NO: 25350 - protein, 23 aa, Artificial Sequence
  Description of Artificial Sequence: Synthetic peptide
  Seed: EGWLHKRGKYIKTWRPRYFLLKN (AKT1 E17K)
  Core: WLHKRGKYI
  misc_feature (3)..(3): Xaa can be Ala, Cys, Asp, Glu, Phe, His, Ile, Lys, Leu, Met, Asn, Pro, Gln, Arg, Thr, Val, Trp, or Ty r
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EGXLHXRXKYXKTWRPRYFLLKN

SEQ ID NO: 25351 - protein, 23 aa, Artificial Sequence
  Description of Artificial Sequence: Synthetic peptide
  Seed: EGWLHKRGKYIKTWRPRYFLLKN (AKT1 E17K)
  Core: GKYIKTWRP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EGWLHKRXKYXKXWRXRYFLLKN

SEQ ID NO: 25352 - protein, 24 aa, Artificial Sequence
  Description of Artificial Sequence: Synthetic peptide
  Seed: EGWLHKRGKYIKTWRPRYFLLKND (AKT1 E17K)
  Core: WLHKRGKYI
  misc_feature (3)..(3): Xaa can be Ala, Cys, Asp, Glu, Phe, His, Ile, Leu, Met, Asn, Pro, Gln, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Gly, His, Ile, Lys, Leu, Met, Asn, Pro, Gln, Arg, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EGXLHXRXKYXKTWRPRYFLLKND

SEQ ID NO: 25353 - protein, 24 aa, Artificial Sequence
  Description of Artificial Sequence: Synthetic peptide
  Seed: EGWLHKRGKYIKTWRPRYFLLKND (AKT1 E17K)
  Core: GKYIKTWRP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EGWLHKRXKYXKXWRXRYFLLKND

SEQ ID NO: 25354 - protein, 25 aa, Artificial Sequence
  Description of Artificial Sequence: Synthetic peptide
  Seed: EGWLHKRGKYIKTWRPRYFLLKNDG (AKT1 E17K)
  Core: WLHKRGKYI
  misc_feature (3)..(3): Xaa can be Ala, Cys, Asp, Glu, Phe, His, Ile, Leu, Met, Asn, Pro, Gln, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Gly, His, Ile, Lys, Leu, Met, Asn, Pro, Gln, Arg, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EGXLHXRXKYXKTWRPRYFLLKNDG

SEQ ID NO: 25355 - protein, 25 aa, Artificial Sequence
  Description of Artificial Sequence: Synthetic peptide
  Seed: EGWLHKRGKYIKTWRPRYFLLKNDG (AKT1 E17K)
  Core: GKYIKTWRP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EGWLHKRXKYXKXWRXRYFLLKNDG

SEQ ID NO: 25356 - protein, 15 aa, Artificial Sequence
  Description of Artificial Sequence: Synthetic peptide
  Seed: GWLHKRGKYIKTWRP (AKT1 E17K)
  Core: WLHKRGKYI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXLHXRXKYXKTWRP

SEQ ID NO: 25357 - protein, 15 aa, Artificial Sequence
  Description of Artificial Sequence: Synthetic peptide
  Seed: GWLHKRGKYIKTWRP (AKT1 E17K)
  Core: GKYIKTWRP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GWLHKRXKYXKXWRX

SEQ ID NO: 25358 - protein, 16 aa, Artificial Sequence
  Description of Artificial Sequence: Synthetic peptide
  Seed: GWLHKRGKYIKTWRPR (AKT1 E17K)
  Core: WLHKRGKYI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Gly, His, Ile, Lys, Leu, Met, Asn, Pro, Gln, Arg, Ser, Thr, or Val
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXLHXRXKYXKTWRPR

SEQ ID NO: 25359 - protein, 16 aa, Artificial Sequence
  Description of Artificial Sequence: Synthetic peptide
  Seed: GWLHKRGKYIKTWRPR (AKT1 E17K)
  Core: GKYIKTWRP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GWLHKRXKYXKXWRXR

SEQ ID NO: 25360 - protein, 17 aa, Artificial Sequence
  Description of Artificial Sequence: Synthetic peptide
  Seed: GWLHKRGKYIKTWRPRY (AKT1 E17K)
  Core: WLHKRGKYI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Gly, His, Lys, Asn, Pro, Gln, Arg, Ser, Thr, or Val
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXLHXRXKYXKTWRPRY

SEQ ID NO: 25361 - protein, 17 aa, Artificial Sequence
  Description of Artificial Sequence: Synthetic peptide
  Seed: GWLHKRGKYIKTWRPRY (AKT1 E17K)
  Core: GKYIKTWRP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GWLHKRXKYXKXWRXRY

SEQ ID NO: 25362 - protein, 19 aa, Artificial Sequence
  Description of Artificial Sequence: Synthetic peptide
  Seed: GWLHKRGKYIKTWRPRYFL (AKT1 E17K)
  Core: GKYIKTWRP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GWLHKRXKYXKXWRXRYFL

SEQ ID NO: 25363 - protein, 20 aa, Artificial Sequence
  Description of Artificial Sequence: Synthetic peptide
  Seed: GWLHKRGKYIKTWRPRYFLL (AKT1 E17K)
  Core: WLHKRGKYI
  misc_feature (2)..(2): Xaa can be Phe, Ile, Leu, Met, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Gly, His, Asn, Pro, Ser, Thr, or Val
  misc_feature (10)..(10): Xaa can be Ala, Cys, Gly, Ile, Leu, Met, Asn, Ser, Thr, or Val
GXLHXRXKYXKTWRPRYFLL

SEQ ID NO: 25364 - protein, 20 aa, Artificial Sequence
  Description of Artificial Sequence: Synthetic peptide
  Seed: GWLHKRGKYIKTWRPRYFLL (AKT1 E17K)
  Core: GKYIKTWRP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GWLHKRXKYXKXWRXRYFLL

SEQ ID NO: 25365 - protein, 21 aa, Artificial Sequence
  Description of Artificial Sequence: Synthetic peptide
  Seed: GWLHKRGKYIKTWRPRYFLLK (AKT1 E17K)
  Core: GKYIKTWRP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GWLHKRXKYXKXWRXRYFLLK

SEQ ID NO: 25366 - protein, 22 aa, Artificial Sequence
  Description of Artificial Sequence: Synthetic peptide
  Seed: GWLHKRGKYIKTWRPRYFLLKN (AKT1 E17K)
  Core: GKYIKTWRP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GWLHKRXKYXKXWRXRYFLLKN

SEQ ID NO: 25367 - protein, 23 aa, Artificial Sequence
  Description of Artificial Sequence: Synthetic peptide
  Seed: GWLHKRGKYIKTWRPRYFLLKND (AKT1 E17K)
  Core: GKYIKTWRP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GWLHKRXKYXKXWRXRYFLLKND

SEQ ID NO: 25368 - protein, 24 aa, Artificial Sequence
  Description of Artificial Sequence: Synthetic peptide
  Seed: GWLHKRGKYIKTWRPRYFLLKNDG (AKT1 E17K)
  Core: GKYIKTWRP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GWLHKRXKYXKXWRXRYFLLKNDG

SEQ ID NO: 25369 - protein, 14 aa, Artificial Sequence
  Description of Artificial Sequence: Synthetic peptide
  Seed: HKRGKYIKTWRPRY (AKT1 E17K)
  Core: GKYIKTWRP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HKRXKYXKXWRXRY

SEQ ID NO: 25370 - protein, 15 aa, Artificial Sequence
  Description of Artificial Sequence: Synthetic peptide
  Seed: HKRGKYIKTWRPRYF (AKT1 E17K)
  Core: GKYIKTWRP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HKRXKYXKXWRXRYF

SEQ ID NO: 25371 - protein, 16 aa, Artificial Sequence
  Description of Artificial Sequence: Synthetic peptide
  Seed: HKRGKYIKTWRPRYFL (AKT1 E17K)
  Core: GKYIKTWRP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HKRXKYXKXWRXRYFL

SEQ ID NO: 25372 - protein, 17 aa, Artificial Sequence
  Description of Artificial Sequence: Synthetic peptide
  Seed: HKRGKYIKTWRPRYFLL (AKT1 E17K)
  Core: GKYIKTWRP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HKRXKYXKXWRXRYFLL

SEQ ID NO: 25373 - protein, 14 aa, Artificial Sequence
  Description of Artificial Sequence: Synthetic peptide
  Seed: IVKEGWLHKRGKYI (AKT1 E17K)
  Core: GWLHKRGKY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVKEXWLXKXGKXI

SEQ ID NO: 25374 - protein, 15 aa, Artificial Sequence
  Description of Artificial Sequence: Synthetic peptide
  Seed: IVKEGWLHKRGKYIK (AKT1 E17K)
  Core: GWLHKRGKY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVKEXWLXKXGKXIK

SEQ ID NO: 25375 - protein, 15 aa, Artificial Sequence
  Description of Artificial Sequence: Synthetic peptide
  Seed: IVKEGWLHKRGKYIK (AKT1 E17K)
  Core: WLHKRGKYI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGXLHXRXKYXK

SEQ ID NO: 25376 - protein, 16 aa, Artificial Sequence
  Description of Artificial Sequence: Synthetic peptide
  Seed: IVKEGWLHKRGKYIKT (AKT1 E17K)
  Core: GWLHKRGKY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVKEXWLXKXGKXIKT

SEQ ID NO: 25377 - protein, 16 aa, Artificial Sequence
  Description of Artificial Sequence: Synthetic peptide
  Seed: IVKEGWLHKRGKYIKT (AKT1 E17K)
  Core: WLHKRGKYI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGXLHXRXKYXKT

SEQ ID NO: 25378 - protein, 17 aa, Artificial Sequence
  Description of Artificial Sequence: Synthetic peptide
  Seed: IVKEGWLHKRGKYIKTW (AKT1 E17K)
  Core: WLHKRGKYI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGXLHXRXKYXKTW

SEQ ID NO: 25379 - protein, 19 aa, Artificial Sequence
  Description of Artificial Sequence: Synthetic peptide
  Seed: IVKEGWLHKRGKYIKTWRP (AKT1 E17K)
  Core: WLHKRGKYI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGXLHXRXKYXKTWRP

SEQ ID NO: 25380 - protein, 20 aa, Artificial Sequence
  Description of Artificial Sequence: Synthetic peptide
  Seed: IVKEGWLHKRGKYIKTWRPR (AKT1 E17K)
  Core: WLHKRGKYI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGXLHXRXKYXKTWRPR

SEQ ID NO: 25381 - protein, 21 aa, Artificial Sequence
  Description of Artificial Sequence: Synthetic peptide
  Seed: IVKEGWLHKRGKYIKTWRPRY (AKT1 E17K)
  Core: WLHKRGKYI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGXLHXRXKYXKTWRPRY

SEQ ID NO: 25382 - protein, 21 aa, Artificial Sequence
  Description of Artificial Sequence: Synthetic peptide
  Seed: IVKEGWLHKRGKYIKTWRPRY (AKT1 E17K)
  Core: GKYIKTWRP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGWLHKRXKYXKXWRXRY

SEQ ID NO: 25383 - protein, 22 aa, Artificial Sequence
  Description of Artificial Sequence: Synthetic peptide
  Seed: IVKEGWLHKRGKYIKTWRPRYF (AKT1 E17K)
  Core: WLHKRGKYI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGXLHXRXKYXKTWRPRYF

SEQ ID NO: 25384 - protein, 22 aa, Artificial Sequence
  Description of Artificial Sequence: Synthetic peptide
  Seed: IVKEGWLHKRGKYIKTWRPRYF (AKT1 E17K)
  Core: GKYIKTWRP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGWLHKRXKYXKXWRXRYF

SEQ ID NO: 25385 - protein, 23 aa, Artificial Sequence
  Description of Artificial Sequence: Synthetic peptide
  Seed: IVKEGWLHKRGKYIKTWRPRYFL (AKT1 E17K)
  Core: WLHKRGKYI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGXLHXRXKYXKTWRPRYFL

SEQ ID NO: 25386 - protein, 23 aa, Artificial Sequence
  Description of Artificial Sequence: Synthetic peptide
  Seed: IVKEGWLHKRGKYIKTWRPRYFL (AKT1 E17K)
  Core: HKRGKYIKT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGWLXKRXKXIKXWRPRYFL

SEQ ID NO: 25387 - protein, 23 aa, Artificial Sequence
  Description of Artificial Sequence: Synthetic peptide
  Seed: IVKEGWLHKRGKYIKTWRPRYFL (AKT1 E17K)
  Core: GKYIKTWRP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGWLHKRXKYXKXWRXRYFL

SEQ ID NO: 25388 - protein, 24 aa, Artificial Sequence
  Description of Artificial Sequence: Synthetic peptide
  Seed: IVKEGWLHKRGKYIKTWRPRYFLL (AKT1 E17K)
  Core: WLHKRGKYI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGXLHXRXKYXKTWRPRYFLL

SEQ ID NO: 25389 - protein, 24 aa, Artificial Sequence
  Description of Artificial Sequence: Synthetic peptide
  Seed: IVKEGWLHKRGKYIKTWRPRYFLL (AKT1 E17K)
  Core: HKRGKYIKT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGWLXKRXKXIKXWRPRYFLL

SEQ ID NO: 25390 - protein, 24 aa, Artificial Sequence
  Description of Artificial Sequence: Synthetic peptide
  Seed: IVKEGWLHKRGKYIKTWRPRYFLL (AKT1 E17K)
  Core: GKYIKTWRP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGWLHKRXKYXKXWRXRYFLL

SEQ ID NO: 25391 - protein, 25 aa, Artificial Sequence
  Description of Artificial Sequence: Synthetic peptide
  Seed: IVKEGWLHKRGKYIKTWRPRYFLLK (AKT1 E17K)
  Core: WLHKRGKYI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGXLHXRXKYXKTWRPRYFLLK

SEQ ID NO: 25392 - protein, 25 aa, Artificial Sequence
  Description of Artificial Sequence: Synthetic peptide
  Seed: IVKEGWLHKRGKYIKTWRPRYFLLK (AKT1 E17K)
  Core: HKRGKYIKT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGWLXKRXKXIKXWRPRYFLLK

SEQ ID NO: 25393 - protein, 25 aa, Artificial Sequence
  Description of Artificial Sequence: Synthetic peptide
  Seed: IVKEGWLHKRGKYIKTWRPRYFLLK (AKT1 E17K)
  Core: GKYIKTWRP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVKEGWLHKRXKYXKXWRXRYFLLK

SEQ ID NO: 25394 - protein, 14 aa, Artificial Sequence
  Description of Artificial Sequence: Synthetic peptide
  Seed: KEGWLHKRGKYIKT (AKT1 E17K)
  Core: WLHKRGKYI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KEGXLHXRXKYXKT

SEQ ID NO: 25395 - protein, 15 aa, Artificial Sequence
  Description of Artificial Sequence: Synthetic peptide
  Seed: KEGWLHKRGKYIKTW (AKT1 E17K)
  Core: WLHKRGKYI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KEGXLHXRXKYXKTW

SEQ ID NO: 25396 - protein, 16 aa, Artificial Sequence
  Description of Artificial Sequence: Synthetic peptide
  Seed: KEGWLHKRGKYIKTWR (AKT1 E17K)
  Core: WLHKRGKYI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KEGXLHXRXKYXKTWR

SEQ ID NO: 25397 - protein, 17 aa, Artificial Sequence
  Description of Artificial Sequence: Synthetic peptide
  Seed: KEGWLHKRGKYIKTWRP (AKT1 E17K)
  Core: WLHKRGKYI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KEGXLHXRXKYXKTWRP

SEQ ID NO: 25398 - protein, 19 aa, Artificial Sequence
  Description of Artificial Sequence: Synthetic peptide
  Seed: KEGWLHKRGKYIKTWRPRY (AKT1 E17K)
  Core: WLHKRGKYI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KEGXLHXRXKYXKTWRPRY

SEQ ID NO: 25399 - protein, 19 aa, Artificial Sequence
  Description of Artificial Sequence: Synthetic peptide
  Seed: KEGWLHKRGKYIKTWRPRY (AKT1 E17K)
  Core: GKYIKTWRP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KEGWLHKRXKYXKXWRXRY

SEQ ID NO: 25400 - protein, 20 aa, Artificial Sequence
  Description of Artificial Sequence: Synthetic peptide
  Seed: KEGWLHKRGKYIKTWRPRYF (AKT1 E17K)
  Core: WLHKRGKYI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KEGXLHXRXKYXKTWRPRYF

SEQ ID NO: 25401 - protein, 20 aa, Artificial Sequence
  Description of Artificial Sequence: Synthetic peptide
  Seed: KEGWLHKRGKYIKTWRPRYF (AKT1 E17K)
  Core: HKRGKYIKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KEGWLXKRXKXIKXWRPRYF

SEQ ID NO: 25402 - protein, 20 aa, Artificial Sequence
  Description of Artificial Sequence: Synthetic peptide
  Seed: KEGWLHKRGKYIKTWRPRYF (AKT1 E17K)
  Core: GKYIKTWRP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KEGWLHKRXKYXKXWRXRYF

SEQ ID NO: 25403 - protein, 21 aa, Artificial Sequence
  Description of Artificial Sequence: Synthetic peptide
  Seed: KEGWLHKRGKYIKTWRPRYFL (AKT1 E17K)
  Core: WLHKRGKYI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KEGXLHXRXKYXKTWRPRYFL

SEQ ID NO: 25404 - protein, 21 aa, Artificial Sequence
  Description of Artificial Sequence: Synthetic peptide
  Seed: KEGWLHKRGKYIKTWRPRYFL (AKT1 E17K)
  Core: GKYIKTWRP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KEGWLHKRXKYXKXWRXRYFL

SEQ ID NO: 25405 - protein, 22 aa, Artificial Sequence
  Description of Artificial Sequence: Synthetic peptide
  Seed: KEGWLHKRGKYIKTWRPRYFLL (AKT1 E17K)
  Core: WLHKRGKYI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KEGXLHXRXKYXKTWRPRYFLL

SEQ ID NO: 25406 - protein, 22 aa, Artificial Sequence
  Description of Artificial Sequence: Synthetic peptide
  Seed: KEGWLHKRGKYIKTWRPRYFLL (AKT1 E17K)
  Core: HKRGKYIKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KEGWLXKRXKXIKXWRPRYFLL

SEQ ID NO: 25407 - protein, 22 aa, Artificial Sequence
  Description of Artificial Sequence: Synthetic peptide
  Seed: KEGWLHKRGKYIKTWRPRYFLL (AKT1 E17K)
  Core: GKYIKTWRP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KEGWLHKRXKYXKXWRXRYFLL

SEQ ID NO: 25408 - protein, 23 aa, Artificial Sequence
  Description of Artificial Sequence: Synthetic peptide
  Seed: KEGWLHKRGKYIKTWRPRYFLLK (AKT1 E17K)
  Core: WLHKRGKYI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KEGXLHXRXKYXKTWRPRYFLLK

SEQ ID NO: 25409 - protein, 23 aa, Artificial Sequence
  Description of Artificial Sequence: Synthetic peptide
  Seed: KEGWLHKRGKYIKTWRPRYFLLK (AKT1 E17K)
  Core: HKRGKYIKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KEGWLXKRXKXIKXWRPRYFLLK

SEQ ID NO: 25410 - protein, 23 aa, Artificial Sequence
  Description of Artificial Sequence: Synthetic peptide
  Seed: KEGWLHKRGKYIKTWRPRYFLLK (AKT1 E17K)
  Core: GKYIKTWRP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KEGWLHKRXKYXKXWRXRYFLLK

SEQ ID NO: 25411 - protein, 24 aa, Artificial Sequence
  Description of Artificial Sequence: Synthetic peptide
  Seed: KEGWLHKRGKYIKTWRPRYFLLKN (AKT1 E17K)
  Core: WLHKRGKYI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KEGXLHXRXKYXKTWRPRYFLLKN

SEQ ID NO: 25412 - protein, 24 aa, Artificial Sequence
  Description of Artificial Sequence: Synthetic peptide
  Seed: KEGWLHKRGKYIKTWRPRYFLLKN (AKT1 E17K)
  Core: HKRGKYIKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KEGWLXKRXKXIKXWRPRYFLLKN

SEQ ID NO: 25413 - protein, 24 aa, Artificial Sequence
  Description of Artificial Sequence: Synthetic peptide
  Seed: KEGWLHKRGKYIKTWRPRYFLLKN (AKT1 E17K)
  Core: GKYIKTWRP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KEGWLHKRXKYXKXWRXRYFLLKN

SEQ ID NO: 25414 - protein, 25 aa, Artificial Sequence
  Description of Artificial Sequence: Synthetic peptide
  Seed: KEGWLHKRGKYIKTWRPRYFLLKND (AKT1 E17K)
  Core: WLHKRGKYI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KEGXLHXRXKYXKTWRPRYFLLKND

SEQ ID NO: 25415 - protein, 25 aa, Artificial Sequence
  Description of Artificial Sequence: Synthetic peptide
  Seed: KEGWLHKRGKYIKTWRPRYFLLKND (AKT1 E17K)
  Core: HKRGKYIKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KEGWLXKRXKXIKXWRPRYFLLKND

SEQ ID NO: 25416 - protein, 25 aa, Artificial Sequence
  Description of Artificial Sequence: Synthetic peptide
  Seed: KEGWLHKRGKYIKTWRPRYFLLKND (AKT1 E17K)
  Core: GKYIKTWRP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KEGWLHKRXKYXKXWRXRYFLLKND

SEQ ID NO: 25417 - protein, 14 aa, Artificial Sequence
  Description of Artificial Sequence: Synthetic peptide
  Seed: KRGKYIKTWRPRYF (AKT1 E17K)
  Core: GKYIKTWRP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KRXKYXKXWRXRYF

SEQ ID NO: 25418 - protein, 15 aa, Artificial Sequence
  Description of Artificial Sequence: Synthetic peptide
  Seed: KRGKYIKTWRPRYFL (AKT1 E17K)
  Core: GKYIKTWRP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KRXKYXKXWRXRYFL

SEQ ID NO: 25419 - protein, 15 aa, Artificial Sequence
  Description of Artificial Sequence: Synthetic peptide
  Seed: LHKRGKYIKTWRPRY (AKT1 E17K)
  Core: GKYIKTWRP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHKRXKYXKXWRXRY

SEQ ID NO: 25420 - protein, 16 aa, Artificial Sequence
  Description of Artificial Sequence: Synthetic peptide
  Seed: LHKRGKYIKTWRPRYF (AKT1 E17K)
  Core: GKYIKTWRP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHKRXKYXKXWRXRYF

SEQ ID NO: 25421 - protein, 17 aa, Artificial Sequence
  Description of Artificial Sequence: Synthetic peptide
  Seed: LHKRGKYIKTWRPRYFL (AKT1 E17K)
  Core: GKYIKTWRP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHKRXKYXKXWRXRYFL

SEQ ID NO: 25422 - protein, 18 aa, Artificial Sequence
  Description of Artificial Sequence: Synthetic peptide
  Seed: LHKRGKYIKTWRPRYFLL (AKT1 E17K)
  Core: GKYIKTWRP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHKRXKYXKXWRXRYFLL

SEQ ID NO: 25423 - protein, 19 aa, Artificial Sequence
  Description of Artificial Sequence: Synthetic peptide
  Seed: LHKRGKYIKTWRPRYFLLK (AKT1 E17K)
  Core: GKYIKTWRP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHKRXKYXKXWRXRYFLLK

SEQ ID NO: 25424 - protein, 20 aa, Artificial Sequence
  Description of Artificial Sequence: Synthetic peptide
  Seed: LHKRGKYIKTWRPRYFLLKN (AKT1 E17K)
  Core: GKYIKTWRP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHKRXKYXKXWRXRYFLLKN

SEQ ID NO: 25425 - protein, 22 aa, Artificial Sequence
  Description of Artificial Sequence: Synthetic peptide
  Seed: LHKRGKYIKTWRPRYFLLKNDG (AKT1 E17K)
  Core: GKYIKTWRP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHKRXKYXKXWRXRYFLLKNDG

SEQ ID NO: 25426 - protein, 20 aa, Artificial Sequence
  Description of Artificial Sequence: Synthetic peptide
  Seed: MSDVAIVKEGWLHKRGKYIK (AKT1 E17K)
  Core: WLHKRGKYI
  misc_feature (11)..(11): Xaa can be Ala, Cys, Asp, Glu, Phe, His, Ile, Lys, Leu, Met, Asn, Pro, Gln, Arg, Thr, Val, Trp, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MSDVAIVKEGXLHXRXKYXK

SEQ ID NO: 25427 - protein, 21 aa, Artificial Sequence
  Description of Artificial Sequence: Synthetic peptide
  Seed: MSDVAIVKEGWLHKRGKYIKT (AKT1 E17K)
  Core: GWLHKRGKY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MSDVAIVKEXWLXKXGKXIKT

SEQ ID NO: 25428 - protein, 21 aa, Artificial Sequence
  Description of Artificial Sequence: Synthetic peptide
  Seed: MSDVAIVKEGWLHKRGKYIKT (AKT1 E17K)
  Core: WLHKRGKYI
  misc_feature (11)..(11): Xaa can be Cys, Phe, His, Ile, Lys, Leu, Met, Gln, Arg, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MSDVAIVKEGXLHXRXKYXKT

SEQ ID NO: 25429 - protein, 22 aa, Artificial Sequence
  Description of Artificial Sequence: Synthetic peptide
  Seed: MSDVAIVKEGWLHKRGKYIKTW (AKT1 E17K)
  Core: GWLHKRGKY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MSDVAIVKEXWLXKXGKXIKTW

SEQ ID NO: 25430 - protein, 22 aa, Artificial Sequence
  Description of Artificial Sequence: Synthetic peptide
  Seed: MSDVAIVKEGWLHKRGKYIKTW (AKT1 E17K)
  Core: WLHKRGKYI
  misc_feature (11)..(11): Xaa can be Ala, Cys, Asp, Glu, Phe, His, Ile, Lys, Leu, Met, Pro, Gln, Arg, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MSDVAIVKEGXLHXRXKYXKTW

SEQ ID NO: 25431 - protein, 23 aa, Artificial Sequence
  Description of Artificial Sequence: Synthetic peptide
  Seed: MSDVAIVKEGWLHKRGKYIKTWR (AKT1 E17K)
  Core: WLHKRGKYI
  misc_feature (11)..(11): Xaa can be Ala, Cys, Asp, Glu, Phe, His, Ile, Lys, Leu, Met, Pro, Gln, Arg, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MSDVAIVKEGXLHXRXKYXKTWR

SEQ ID NO: 25432 - protein, 24 aa, Artificial Sequence
  Description of Artificial Sequence: Synthetic peptide
  Seed: MSDVAIVKEGWLHKRGKYIKTWRP (AKT1 E17K)
  Core: WLHKRGKYI
  misc_feature (11)..(11): Xaa can be Ala, Cys, Asp, Glu, Phe, Gly, His, Ile, Lys, Leu, Met, Pro, Gln, Arg, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MSDVAIVKEGXLHXRXKYXKTWRP

SEQ ID NO: 25433 - protein, 25 aa, Artificial Sequence
  Description of Artificial Sequence: Synthetic peptide
  Seed: MSDVAIVKEGWLHKRGKYIKTWRPR (AKT1 E17K)
  Core: WLHKRGKYI
  misc_feature (11)..(11): Xaa can be Ala, Cys, Asp, Glu, Phe, Gly, His, Ile, Lys, Leu, Met, Pro, Gln, Arg, Thr, Val, Trp, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MSDVAIVKEGXLHXRXKYXKTWRPR

SEQ ID NO: 25434 - protein, 19 aa, Artificial Sequence
  Description of Artificial Sequence: Synthetic peptide
  Seed: SDVAIVKEGWLHKRGKYIK (AKT1 E17K)
  Core: GWLHKRGKY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SDVAIVKEXWLXKXGKXIK

SEQ ID NO: 25435 - protein, 19 aa, Artificial Sequence
  Description of Artificial Sequence: Synthetic peptide
  Seed: SDVAIVKEGWLHKRGKYIK (AKT1 E17K)
  Core: WLHKRGKYI
  misc_feature (10)..(10): Xaa can be Phe, Ile, Leu, Met, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SDVAIVKEGXLHXRXKYXK

SEQ ID NO: 25436 - protein, 20 aa, Artificial Sequence
  Description of Artificial Sequence: Synthetic peptide
  Seed: SDVAIVKEGWLHKRGKYIKT (AKT1 E17K)
  Core: GWLHKRGKY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SDVAIVKEXWLXKXGKXIKT

SEQ ID NO: 25437 - protein, 20 aa, Artificial Sequence
  Description of Artificial Sequence: Synthetic peptide
  Seed: SDVAIVKEGWLHKRGKYIKT (AKT1 E17K)
  Core: WLHKRGKYI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SDVAIVKEGXLHXRXKYXKT

SEQ ID NO: 25438 - protein, 21 aa, Artificial Sequence
  Description of Artificial Sequence: Synthetic peptide
  Seed: SDVAIVKEGWLHKRGKYIKTW (AKT1 E17K)
  Core: GWLHKRGKY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SDVAIVKEXWLXKXGKXIKTW

SEQ ID NO: 25439 - protein, 21 aa, Artificial Sequence
  Description of Artificial Sequence: Synthetic peptide
  Seed: SDVAIVKEGWLHKRGKYIKTW (AKT1 E17K)
  Core: WLHKRGKYI
  misc_feature (10)..(10): Xaa can be Ala, Cys, Asp, Glu, Phe, Gly, His, Ile, Lys, Leu, Met, Pro, Gln, Arg, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SDVAIVKEGXLHXRXKYXKTW

SEQ ID NO: 25440 - protein, 22 aa, Artificial Sequence
  Description of Artificial Sequence: Synthetic peptide
  Seed: SDVAIVKEGWLHKRGKYIKTWR (AKT1 E17K)
  Core: WLHKRGKYI
  misc_feature (10)..(10): Xaa can be Ala, Cys, Asp, Glu, Phe, Gly, His, Ile, Lys, Leu, Met, Pro, Gln, Arg, Thr, Val, Trp, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SDVAIVKEGXLHXRXKYXKTWR

SEQ ID NO: 25441 - protein, 23 aa, Artificial Sequence
  Description of Artificial Sequence: Synthetic peptide
  Seed: SDVAIVKEGWLHKRGKYIKTWRP (AKT1 E17K)
  Core: WLHKRGKYI
  misc_feature (10)..(10): Xaa can be Ala, Cys, Asp, Glu, Phe, Gly, His, Ile, Lys, Leu, Met, Asn, Pro, Gln, Arg, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SDVAIVKEGXLHXRXKYXKTWRP

SEQ ID NO: 25442 - protein, 24 aa, Artificial Sequence
  Description of Artificial Sequence: Synthetic peptide
  Seed: SDVAIVKEGWLHKRGKYIKTWRPR (AKT1 E17K)
  Core: WLHKRGKYI
  misc_feature (10)..(10): Xaa can be Ala, Cys, Asp, Glu, Phe, Gly, His, Ile, Lys, Leu, Met, Asn, Pro, Gln, Arg, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SDVAIVKEGXLHXRXKYXKTWRPR

SEQ ID NO: 25443 - protein, 25 aa, Artificial Sequence
  Description of Artificial Sequence: Synthetic peptide
  Seed: SDVAIVKEGWLHKRGKYIKTWRPRY (AKT1 E17K)
  Core: WLHKRGKYI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SDVAIVKEGXLHXRXKYXKTWRPRY

SEQ ID NO: 25444 - protein, 25 aa, Artificial Sequence
  Description of Artificial Sequence: Synthetic peptide
  Seed: SDVAIVKEGWLHKRGKYIKTWRPRY (AKT1 E17K)
  Core: GKYIKTWRP
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SDVAIVKEGWLHKRXKYXKXWRXRY

SEQ ID NO: 25445 - protein, 16 aa, Artificial Sequence
  Description of Artificial Sequence: Synthetic peptide
  Seed: VAIVKEGWLHKRGKYI (AKT1 E17K)
  Core: GWLHKRGKY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VAIVKEXWLXKXGKXI

SEQ ID NO: 25446 - protein, 17 aa, Artificial Sequence
  Description of Artificial Sequence: Synthetic peptide
  Seed: VAIVKEGWLHKRGKYIK (AKT1 E17K)
  Core: GWLHKRGKY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VAIVKEXWLXKXGKXIK

SEQ ID NO: 25447 - protein, 17 aa, Artificial Sequence
  Description of Artificial Sequence: Synthetic peptide
  Seed: VAIVKEGWLHKRGKYIK (AKT1 E17K)
  Core: WLHKRGKYI
  misc_feature (8)..(8): Xaa can be Ala, Cys, Asp, Glu, Phe, His, Ile, Lys, Leu, Met, Asn, Pro, Gln, Arg, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VAIVKEGXLHXRXKYXK

SEQ ID NO: 25448 - protein, 19 aa, Artificial Sequence
  Description of Artificial Sequence: Synthetic peptide
  Seed: VAIVKEGWLHKRGKYIKTW (AKT1 E17K)
  Core: GWLHKRGKY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VAIVKEXWLXKXGKXIKTW

SEQ ID NO: 25449 - protein, 19 aa, Artificial Sequence
  Description of Artificial Sequence: Synthetic peptide
  Seed: VAIVKEGWLHKRGKYIKTW (AKT1 E17K)
  Core: WLHKRGKYI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VAIVKEGXLHXRXKYXKTW

SEQ ID NO: 25450 - protein, 20 aa, Artificial Sequence
  Description of Artificial Sequence: Synthetic peptide
  Seed: VAIVKEGWLHKRGKYIKTWR (AKT1 E17K)
  Core: WLHKRGKYI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VAIVKEGXLHXRXKYXKTWR

SEQ ID NO: 25451 - protein, 21 aa, Artificial Sequence
  Description of Artificial Sequence: Synthetic peptide
  Seed: VAIVKEGWLHKRGKYIKTWRP (AKT1 E17K)
  Core: WLHKRGKYI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VAIVKEGXLHXRXKYXKTWRP

SEQ ID NO: 25452 - protein, 22 aa, Artificial Sequence
  Description of Artificial Sequence: Synthetic peptide
  Seed: VAIVKEGWLHKRGKYIKTWRPR (AKT1 E17K)
  Core: WLHKRGKYI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VAIVKEGXLHXRXKYXKTWRPR

SEQ ID NO: 25453 - protein, 23 aa, Artificial Sequence
  Description of Artificial Sequence: Synthetic peptide
  Seed: VAIVKEGWLHKRGKYIKTWRPRY (AKT1 E17K)
  Core: WLHKRGKYI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VAIVKEGXLHXRXKYXKTWRPRY

SEQ ID NO: 25454 - protein, 23 aa, Artificial Sequence
  Description of Artificial Sequence: Synthetic peptide
  Seed: VAIVKEGWLHKRGKYIKTWRPRY (AKT1 E17K)
  Core: GKYIKTWRP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VAIVKEGWLHKRXKYXKXWRXRY

SEQ ID NO: 25455 - protein, 24 aa, Artificial Sequence
  Description of Artificial Sequence: Synthetic peptide
  Seed: VAIVKEGWLHKRGKYIKTWRPRYF (AKT1 E17K)
  Core: WLHKRGKYI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VAIVKEGXLHXRXKYXKTWRPRYF

SEQ ID NO: 25456 - protein, 24 aa, Artificial Sequence
  Description of Artificial Sequence: Synthetic peptide
  Seed: VAIVKEGWLHKRGKYIKTWRPRYF (AKT1 E17K)
  Core: GKYIKTWRP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VAIVKEGWLHKRXKYXKXWRXRYF

SEQ ID NO: 25457 - protein, 25 aa, Artificial Sequence
  Description of Artificial Sequence: Synthetic peptide
  Seed: VAIVKEGWLHKRGKYIKTWRPRYFL (AKT1 E17K)
  Core: WLHKRGKYI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VAIVKEGXLHXRXKYXKTWRPRYFL

SEQ ID NO: 25458 - protein, 25 aa, Artificial Sequence
  Description of Artificial Sequence: Synthetic peptide
  Seed: VAIVKEGWLHKRGKYIKTWRPRYFL (AKT1 E17K)
  Core: HKRGKYIKT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VAIVKEGWLXKRXKXIKXWRPRYFL

SEQ ID NO: 25459 - protein, 25 aa, Artificial Sequence
  Description of Artificial Sequence: Synthetic peptide
  Seed: VAIVKEGWLHKRGKYIKTWRPRYFL (AKT1 E17K)
  Core: GKYIKTWRP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VAIVKEGWLHKRXKYXKXWRXRYFL

SEQ ID NO: 25460 - protein, 14 aa, Artificial Sequence
  Description of Artificial Sequence: Synthetic peptide
  Seed: VKEGWLHKRGKYIK (AKT1 E17K)
  Core: GWLHKRGKY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKEXWLXKXGKXIK

SEQ ID NO: 25461 - protein, 14 aa, Artificial Sequence
  Description of Artificial Sequence: Synthetic peptide
  Seed: VKEGWLHKRGKYIK (AKT1 E17K)
  Core: WLHKRGKYI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKEGXLHXRXKYXK

SEQ ID NO: 25462 - protein, 15 aa, Artificial Sequence
  Description of Artificial Sequence: Synthetic peptide
  Seed: VKEGWLHKRGKYIKT (AKT1 E17K)
  Core: GWLHKRGKY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKEXWLXKXGKXIKT

SEQ ID NO: 25463 - protein, 15 aa, Artificial Sequence
  Description of Artificial Sequence: Synthetic peptide
  Seed: VKEGWLHKRGKYIKT (AKT1 E17K)
  Core: WLHKRGKYI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKEGXLHXRXKYXKT

SEQ ID NO: 25464 - protein, 16 aa, Artificial Sequence
  Description of Artificial Sequence: Synthetic peptide
  Seed: VKEGWLHKRGKYIKTW (AKT1 E17K)
  Core: WLHKRGKYI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKEGXLHXRXKYXKTW

SEQ ID NO: 25465 - protein, 17 aa, Artificial Sequence
  Description of Artificial Sequence: Synthetic peptide
  Seed: VKEGWLHKRGKYIKTWR (AKT1 E17K)
  Core: WLHKRGKYI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKEGXLHXRXKYXKTWR

SEQ ID NO: 25466 - protein, 19 aa, Artificial Sequence
  Description of Artificial Sequence: Synthetic peptide
  Seed: VKEGWLHKRGKYIKTWRPR (AKT1 E17K)
  Core: WLHKRGKYI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKEGXLHXRXKYXKTWRPR

SEQ ID NO: 25467 - protein, 20 aa, Artificial Sequence
  Description of Artificial Sequence: Synthetic peptide
  Seed: VKEGWLHKRGKYIKTWRPRY (AKT1 E17K)
  Core: WLHKRGKYI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKEGXLHXRXKYXKTWRPRY

SEQ ID NO: 25468 - protein, 20 aa, Artificial Sequence
  Description of Artificial Sequence: Synthetic peptide
  Seed: VKEGWLHKRGKYIKTWRPRY (AKT1 E17K)
  Core: GKYIKTWRP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VKEGWLHKRXKYXKXWRXRY

SEQ ID NO: 25469 - protein, 21 aa, Artificial Sequence
  Description of Artificial Sequence: Synthetic peptide
  Seed: VKEGWLHKRGKYIKTWRPRYF (AKT1 E17K)
  Core: WLHKRGKYI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKEGXLHXRXKYXKTWRPRYF

SEQ ID NO: 25470 - protein, 21 aa, Artificial Sequence
  Description of Artificial Sequence: Synthetic peptide
  Seed: VKEGWLHKRGKYIKTWRPRYF (AKT1 E17K)
  Core: GKYIKTWRP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VKEGWLHKRXKYXKXWRXRYF

SEQ ID NO: 25471 - protein, 22 aa, Artificial Sequence
  Description of Artificial Sequence: Synthetic peptide
  Seed: VKEGWLHKRGKYIKTWRPRYFL (AKT1 E17K)
  Core: WLHKRGKYI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKEGXLHXRXKYXKTWRPRYFL

SEQ ID NO: 25472 - protein, 22 aa, Artificial Sequence
  Description of Artificial Sequence: Synthetic peptide
  Seed: VKEGWLHKRGKYIKTWRPRYFL (AKT1 E17K)
  Core: GKYIKTWRP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VKEGWLHKRXKYXKXWRXRYFL

SEQ ID NO: 25473 - protein, 23 aa, Artificial Sequence
  Description of Artificial Sequence: Synthetic peptide
  Seed: VKEGWLHKRGKYIKTWRPRYFLL (AKT1 E17K)
  Core: WLHKRGKYI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKEGXLHXRXKYXKTWRPRYFLL

SEQ ID NO: 25474 - protein, 23 aa, Artificial Sequence
  Description of Artificial Sequence: Synthetic peptide
  Seed: VKEGWLHKRGKYIKTWRPRYFLL (AKT1 E17K)
  Core: HKRGKYIKT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKEGWLXKRXKXIKXWRPRYFLL

SEQ ID NO: 25475 - protein, 23 aa, Artificial Sequence
  Description of Artificial Sequence: Synthetic peptide
  Seed: VKEGWLHKRGKYIKTWRPRYFLL (AKT1 E17K)
  Core: GKYIKTWRP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VKEGWLHKRXKYXKXWRXRYFLL

SEQ ID NO: 25476 - protein, 24 aa, Artificial Sequence
  Description of Artificial Sequence: Synthetic peptide
  Seed: VKEGWLHKRGKYIKTWRPRYFLLK (AKT1 E17K)
  Core: WLHKRGKYI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKEGXLHXRXKYXKTWRPRYFLLK

SEQ ID NO: 25477 - protein, 24 aa, Artificial Sequence
  Description of Artificial Sequence: Synthetic peptide
  Seed: VKEGWLHKRGKYIKTWRPRYFLLK (AKT1 E17K)
  Core: HKRGKYIKT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKEGWLXKRXKXIKXWRPRYFLLK

SEQ ID NO: 25478 - protein, 24 aa, Artificial Sequence
  Description of Artificial Sequence: Synthetic peptide
  Seed: VKEGWLHKRGKYIKTWRPRYFLLK (AKT1 E17K)
  Core: GKYIKTWRP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VKEGWLHKRXKYXKXWRXRYFLLK

SEQ ID NO: 25479 - protein, 25 aa, Artificial Sequence
  Description of Artificial Sequence: Synthetic peptide
  Seed: VKEGWLHKRGKYIKTWRPRYFLLKN (AKT1 E17K)
  Core: WLHKRGKYI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKEGXLHXRXKYXKTWRPRYFLLKN

SEQ ID NO: 25480 - protein, 25 aa, Artificial Sequence
  Description of Artificial Sequence: Synthetic peptide
  Seed: VKEGWLHKRGKYIKTWRPRYFLLKN (AKT1 E17K)
  Core: HKRGKYIKT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKEGWLXKRXKXIKXWRPRYFLLKN

SEQ ID NO: 25481 - protein, 25 aa, Artificial Sequence
  Description of Artificial Sequence: Synthetic peptide
  Seed: VKEGWLHKRGKYIKTWRPRYFLLKN (AKT1 E17K)
  Core: GKYIKTWRP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VKEGWLHKRXKYXKXWRXRYFLLKN

SEQ ID NO: 25482 - protein, 15 aa, Artificial Sequence
  Description of Artificial Sequence: Synthetic peptide
  Seed: WLHKRGKYIKTWRPR (AKT1 E17K)
  Core: GKYIKTWRP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WLHKRXKYXKXWRXR

SEQ ID NO: 25483 - protein, 16 aa, Artificial Sequence
  Description of Artificial Sequence: Synthetic peptide
  Seed: WLHKRGKYIKTWRPRY (AKT1 E17K)
  Core: GKYIKTWRP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WLHKRXKYXKXWRXRY

SEQ ID NO: 25484 - protein, 17 aa, Artificial Sequence
  Description of Artificial Sequence: Synthetic peptide
  Seed: WLHKRGKYIKTWRPRYF (AKT1 E17K)
  Core: GKYIKTWRP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WLHKRXKYXKXWRXRYF

SEQ ID NO: 25485 - protein, 19 aa, Artificial Sequence
  Description of Artificial Sequence: Synthetic peptide
  Seed: WLHKRGKYIKTWRPRYFLL (AKT1 E17K)
  Core: GKYIKTWRP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WLHKRXKYXKXWRXRYFLL

SEQ ID NO: 25486 - protein, 20 aa, Artificial Sequence
  Description of Artificial Sequence: Synthetic peptide
  Seed: WLHKRGKYIKTWRPRYFLLK (AKT1 E17K)
  Core: GKYIKTWRP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WLHKRXKYXKXWRXRYFLLK

SEQ ID NO: 25487 - protein, 22 aa, Artificial Sequence
  Description of Artificial Sequence: Synthetic peptide
  Seed: WLHKRGKYIKTWRPRYFLLKND (AKT1 E17K)
  Core: GKYIKTWRP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WLHKRXKYXKXWRXRYFLLKND

SEQ ID NO: 25488 - protein, 23 aa, Artificial Sequence
  Description of Artificial Sequence: Synthetic peptide
  Seed: WLHKRGKYIKTWRPRYFLLKNDG (AKT1 E17K)
  Core: GKYIKTWRP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WLHKRXKYXKXWRXRYFLLKNDG

SEQ ID NO: 25489 - protein, 20 aa, Artificial Sequence
  Description of Artificial Sequence: Synthetic peptide
  Seed: DLTVKIGDFGLATEKSRWSG (BRAF V600E)
  Core: DFGLATEKS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLTVKIGXFGXAXEKXRWSG

SEQ ID NO: 25490 - protein, 21 aa, Artificial Sequence
  Description of Artificial Sequence: Synthetic peptide
  Seed: DLTVKIGDFGLATEKSRWSGS (BRAF V600E)
  Core: DFGLATEKS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLTVKIGXFGXAXEKXRWSGS

SEQ ID NO: 25491 - protein, 22 aa, Artificial Sequence
  Description of Artificial Sequence: Synthetic peptide
  Seed: DLTVKIGDFGLATEKSRWSGSH (BRAF V600E)
  Core: DFGLATEKS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLTVKIGXFGXAXEKXRWSGSH

SEQ ID NO: 25492 - protein, 20 aa, Artificial Sequence
  Description of Artificial Sequence: Synthetic peptide
  Seed: EDLTVKIGDFGLATEKSRWS (BRAF V600E)
  Core: DFGLATEKS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EDLTVKIGXFGXAXEKXRWS

SEQ ID NO: 25493 - protein, 21 aa, Artificial Sequence
  Description of Artificial Sequence: Synthetic peptide
  Seed: EDLTVKIGDFGLATEKSRWSG (BRAF V600E)
  Core: DFGLATEKS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EDLTVKIGXFGXAXEKXRWSG

SEQ ID NO: 25494 - protein, 22 aa, Artificial Sequence
  Description of Artificial Sequence: Synthetic peptide
  Seed: EDLTVKIGDFGLATEKSRWSGS (BRAF V600E)
  Core: DFGLATEKS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EDLTVKIGXFGXAXEKXRWSGS

SEQ ID NO: 25495 - protein, 23 aa, Artificial Sequence
  Description of Artificial Sequence: Synthetic peptide
  Seed: EDLTVKIGDFGLATEKSRWSGSH (BRAF V600E)
  Core: DFGLATEKS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EDLTVKIGXFGXAXEKXRWSGSH

SEQ ID NO: 25496 - protein, 24 aa, Artificial Sequence
  Description of Artificial Sequence: Synthetic peptide
  Seed: EDLTVKIGDFGLATEKSRWSGSHQ (BRAF V600E)
  Core: DFGLATEKS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EDLTVKIGXFGXAXEKXRWSGSHQ

SEQ ID NO: 25497 - protein, 25 aa, Artificial Sequence
  Description of Artificial Sequence: Synthetic peptide
  Seed: EDLTVKIGDFGLATEKSRWSGSHQF (BRAF V600E)
  Core: DFGLATEKS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EDLTVKIGXFGXAXEKXRWSGSHQF

SEQ ID NO: 25498 - protein, 15 aa, Artificial Sequence
  Description of Artificial Sequence: Synthetic peptide
  Seed: FGLATEKSRWSGSHQ (BRAF V600E)
  Core: ATEKSRWSG
  misc_feature (4)..(4): Xaa can be Ala, Cys, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FGLXTEXSXWSXSHQ

SEQ ID NO: 25499 - protein, 23 aa, Artificial Sequence
  Description of Artificial Sequence: Synthetic peptide
  Seed: FLHEDLTVKIGDFGLATEKSRWS (BRAF V600E)
  Core: DFGLATEKS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
FLHEDLTVKIGXFGXAXEKXRWS

SEQ ID NO: 25500 - protein, 24 aa, Artificial Sequence
  Description of Artificial Sequence: Synthetic peptide
  Seed: FLHEDLTVKIGDFGLATEKSRWSG (BRAF V600E)
  Core: DFGLATEKS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
FLHEDLTVKIGXFGXAXEKXRWSG

SEQ ID NO: 25501 - protein, 25 aa, Artificial Sequence
  Description of Artificial Sequence: Synthetic peptide
  Seed: FLHEDLTVKIGDFGLATEKSRWSGS (BRAF V600E)
  Core: DFGLATEKS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
FLHEDLTVKIGXFGXAXEKXRWSGS

SEQ ID NO: 25502 - protein, 20 aa, Artificial Sequence
  Description of Artificial Sequence: Synthetic peptide
  Seed: HEDLTVKIGDFGLATEKSRW (BRAF V600E)
  Core: DFGLATEKS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HEDLTVKIGXFGXAXEKXRW

SEQ ID NO: 25503 - protein, 21 aa, Artificial Sequence
  Description of Artificial Sequence: Synthetic peptide
  Seed: HEDLTVKIGDFGLATEKSRWS (BRAF V600E)
  Core: DFGLATEKS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HEDLTVKIGXFGXAXEKXRWS

SEQ ID NO: 25504 - protein, 22 aa, Artificial Sequence
  Description of Artificial Sequence: Synthetic peptide
  Seed: HEDLTVKIGDFGLATEKSRWSG (BRAF V600E)
  Core: DFGLATEKS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HEDLTVKIGXFGXAXEKXRWSG

SEQ ID NO: 25505 - protein, 23 aa, Artificial Sequence
  Description of Artificial Sequence: Synthetic peptide
  Seed: HEDLTVKIGDFGLATEKSRWSGS (BRAF V600E)
  Core: DFGLATEKS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HEDLTVKIGXFGXAXEKXRWSGS

SEQ ID NO: 25506 - protein, 24 aa, Artificial Sequence
  Description of Artificial Sequence: Synthetic peptide
  Seed: HEDLTVKIGDFGLATEKSRWSGSH (BRAF V600E)
  Core: DFGLATEKS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HEDLTVKIGXFGXAXEKXRWSGSH

SEQ ID NO: 25507 - protein, 25 aa, Artificial Sequence
  Description of Artificial Sequence: Synthetic peptide
  Seed: HEDLTVKIGDFGLATEKSRWSGSHQ (BRAF V600E)
  Core: DFGLATEKS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HEDLTVKIGXFGXAXEKXRWSGSHQ

SEQ ID NO: 25508 - protein, 23 aa, Artificial Sequence
  Description of Artificial Sequence: Synthetic peptide
  Seed: IFLHEDLTVKIGDFGLATEKSRW (BRAF V600E)
  Core: DFGLATEKS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IFLHEDLTVKIGXFGXAXEKXRW

SEQ ID NO: 25509 - protein, 24 aa, Artificial Sequence
  Description of Artificial Sequence: Synthetic peptide
  Seed: IFLHEDLTVKIGDFGLATEKSRWS (BRAF V600E)
  Core: DFGLATEKS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IFLHEDLTVKIGXFGXAXEKXRWS

SEQ ID NO: 25510 - protein, 25 aa, Artificial Sequence
  Description of Artificial Sequence: Synthetic peptide
  Seed: IFLHEDLTVKIGDFGLATEKSRWSG (BRAF V600E)
  Core: DFGLATEKS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IFLHEDLTVKIGXFGXAXEKXRWSG

SEQ ID NO: 25511 - protein, 15 aa, Artificial Sequence
  Description of Artificial Sequence: Synthetic peptide
  Seed: KIGDFGLATEKSRWS (BRAF V600E)
  Core: DFGLATEKS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KIGXFGXAXEKXRWS

SEQ ID NO: 25512 - protein, 16 aa, Artificial Sequence
  Description of Artificial Sequence: Synthetic peptide
  Seed: KIGDFGLATEKSRWSG (BRAF V600E)
  Core: DFGLATEKS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KIGXFGXAXEKXRWSG

SEQ ID NO: 25513 - protein, 17 aa, Artificial Sequence
  Description of Artificial Sequence: Synthetic peptide
  Seed: KIGDFGLATEKSRWSGS (BRAF V600E)
  Core: DFGLATEKS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KIGXFGXAXEKXRWSGS

SEQ ID NO: 25514 - protein, 22 aa, Artificial Sequence
  Description of Artificial Sequence: Synthetic peptide
  Seed: LHEDLTVKIGDFGLATEKSRWS (BRAF V600E)
  Core: DFGLATEKS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LHEDLTVKIGXFGXAXEKXRWS

SEQ ID NO: 25515 - protein, 23 aa, Artificial Sequence
  Description of Artificial Sequence: Synthetic peptide
  Seed: LHEDLTVKIGDFGLATEKSRWSG (BRAF V600E)
  Core: DFGLATEKS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LHEDLTVKIGXFGXAXEKXRWSG

SEQ ID NO: 25516 - protein, 24 aa, Artificial Sequence
  Description of Artificial Sequence: Synthetic peptide
  Seed: LHEDLTVKIGDFGLATEKSRWSGS (BRAF V600E)
  Core: DFGLATEKS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LHEDLTVKIGXFGXAXEKXRWSGS

SEQ ID NO: 25517 - protein, 25 aa, Artificial Sequence
  Description of Artificial Sequence: Synthetic peptide
  Seed: LHEDLTVKIGDFGLATEKSRWSGSH (BRAF V600E)
  Core: DFGLATEKS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LHEDLTVKIGXFGXAXEKXRWSGSH

SEQ ID NO: 25518 - protein, 17 aa, Artificial Sequence
  Description of Artificial Sequence: Synthetic peptide
  Seed: LTVKIGDFGLATEKSRW (BRAF V600E)
  Core: DFGLATEKS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LTVKIGXFGXAXEKXRW

SEQ ID NO: 25519 - protein, 19 aa, Artificial Sequence
  Description of Artificial Sequence: Synthetic peptide
  Seed: LTVKIGDFGLATEKSRWSG (BRAF V600E)
  Core: DFGLATEKS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LTVKIGXFGXAXEKXRWSG

SEQ ID NO: 25520 - protein, 20 aa, Artificial Sequence
  Description of Artificial Sequence: Synthetic peptide
  Seed: LTVKIGDFGLATEKSRWSGS (BRAF V600E)
  Core: DFGLATEKS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LTVKIGXFGXAXEKXRWSGS

SEQ ID NO: 25521 - protein, 25 aa, Artificial Sequence
  Description of Artificial Sequence: Synthetic peptide
  Seed: NIFLHEDLTVKIGDFGLATEKSRWS (BRAF V600E)
  Core: DFGLATEKS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
NIFLHEDLTVKIGXFGXAXEKXRWS

SEQ ID NO: 25522 - protein, 15 aa, Artificial Sequence
  Description of Artificial Sequence: Synthetic peptide
  Seed: TVKIGDFGLATEKSR (BRAF V600E)
  Core: DFGLATEKS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TVKIGXFGXAXEKXR

SEQ ID NO: 25523 - protein, 17 aa, Artificial Sequence
  Description of Artificial Sequence: Synthetic peptide
  Seed: TVKIGDFGLATEKSRWS (BRAF V600E)
  Core: DFGLATEKS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TVKIGXFGXAXEKXRWS

SEQ ID NO: 25524 - protein, 19 aa, Artificial Sequence
  Description of Artificial Sequence: Synthetic peptide
  Seed: TVKIGDFGLATEKSRWSGS (BRAF V600E)
  Core: DFGLATEKS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TVKIGXFGXAXEKXRWSGS

SEQ ID NO: 25525 - protein, 15 aa, Artificial Sequence
  Description of Artificial Sequence: Synthetic peptide
  Seed: VKIGDFGLATEKSRW (BRAF V600E)
  Core: DFGLATEKS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKIGXFGXAXEKXRW

SEQ ID NO: 25526 - protein, 17 aa, Artificial Sequence
  Description of Artificial Sequence: Synthetic peptide
  Seed: VKIGDFGLATEKSRWSG (BRAF V600E)
  Core: DFGLATEKS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKIGXFGXAXEKXRWSG

SEQ ID NO: 25527 - protein, 17 aa, Artificial Sequence
  Description of Artificial Sequence: Synthetic peptide
  Seed: DFGLATMKSRWSGSHQF (BRAF V600M)
  Core: ATMKSRWSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DFGLXTMXSXWSXSHQF

SEQ ID NO: 25528 - protein, 19 aa, Artificial Sequence
  Description of Artificial Sequence: Synthetic peptide
  Seed: DFGLATMKSRWSGSHQFEQ (BRAF V600M)
  Core: ATMKSRWSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DFGLXTMXSXWSXSHQFEQ

SEQ ID NO: 25529 - protein, 20 aa, Artificial Sequence
  Description of Artificial Sequence: Synthetic peptide
  Seed: DFGLATMKSRWSGSHQFEQL (BRAF V600M)
  Core: ATMKSRWSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DFGLXTMXSXWSXSHQFEQL

SEQ ID NO: 25530 - protein, 21 aa, Artificial Sequence
  Description of Artificial Sequence: Synthetic peptide
  Seed: DFGLATMKSRWSGSHQFEQLS (BRAF V600M)
  Core: ATMKSRWSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DFGLXTMXSXWSXSHQFEQLS

SEQ ID NO: 25531 - protein, 22 aa, Artificial Sequence
  Description of Artificial Sequence: Synthetic peptide
  Seed: DFGLATMKSRWSGSHQFEQLSG (BRAF V600M)
  Core: ATMKSRWSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DFGLXTMXSXWSXSHQFEQLSG

SEQ ID NO: 25532 - protein, 23 aa, Artificial Sequence
  Description of Artificial Sequence: Synthetic peptide
  Seed: DFGLATMKSRWSGSHQFEQLSGS (BRAF V600M)
  Core: ATMKSRWSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DFGLXTMXSXWSXSHQFEQLSGS

SEQ ID NO: 25533 - protein, 24 aa, Artificial Sequence
  Description of Artificial Sequence: Synthetic peptide
  Seed: DFGLATMKSRWSGSHQFEQLSGSI (BRAF V600M)
  Core: ATMKSRWSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DFGLXTMXSXWSXSHQFEQLSGSI

SEQ ID NO: 25534 - protein, 25 aa, Artificial Sequence
  Description of Artificial Sequence: Synthetic peptide
  Seed: DFGLATMKSRWSGSHQFEQLSGSIL (BRAF V600M)
  Core: ATMKSRWSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DFGLXTMXSXWSXSHQFEQLSGSIL

SEQ ID NO: 25535 - protein, 17 aa, Artificial Sequence
  Description of Artificial Sequence: Synthetic peptide
  Seed: DLTVKIGDFGLATMKSR (BRAF V600M)
  Core: DFGLATMKS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLTVKIGXFGXAXMKXR

SEQ ID NO: 25536 - protein, 19 aa, Artificial Sequence
  Description of Artificial Sequence: Synthetic peptide
  Seed: DLTVKIGDFGLATMKSRWS (BRAF V600M)
  Core: DFGLATMKS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLTVKIGXFGXAXMKXRWS

SEQ ID NO: 25537 - protein, 20 aa, Artificial Sequence
  Description of Artificial Sequence: Synthetic peptide
  Seed: DLTVKIGDFGLATMKSRWSG (BRAF V600M)
  Core: DFGLATMKS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLTVKIGXFGXAXMKXRWSG

SEQ ID NO: 25538 - protein, 21 aa, Artificial Sequence
  Description of Artificial Sequence: Synthetic peptide
  Seed: DLTVKIGDFGLATMKSRWSGS (BRAF V600M)
  Core: DFGLATMKS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLTVKIGXFGXAXMKXRWSGS

SEQ ID NO: 25539 - protein, 22 aa, Artificial Sequence
  Description of Artificial Sequence: Synthetic peptide
  Seed: DLTVKIGDFGLATMKSRWSGSH (BRAF V600M)
  Core: DFGLATMKS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLTVKIGXFGXAXMKXRWSGSH

SEQ ID NO: 25540 - protein, 23 aa, Artificial Sequence
  Description of Artificial Sequence: Synthetic peptide
  Seed: DLTVKIGDFGLATMKSRWSGSHQ (BRAF V600M)
  Core: DFGLATMKS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLTVKIGXFGXAXMKXRWSGSHQ

SEQ ID NO: 25541 - protein, 24 aa, Artificial Sequence
  Description of Artificial Sequence: Synthetic peptide
  Seed: DLTVKIGDFGLATMKSRWSGSHQF (BRAF V600M)
  Core: DFGLATMKS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLTVKIGXFGXAXMKXRWSGSHQF

SEQ ID NO: 25542 - protein, 25 aa, Artificial Sequence
  Description of Artificial Sequence: Synthetic peptide
  Seed: DLTVKIGDFGLATMKSRWSGSHQFE (BRAF V600M)
  Core: DFGLATMKS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLTVKIGXFGXAXMKXRWSGSHQFE

SEQ ID NO: 25543 - protein, 19 aa, Artificial Sequence
  Description of Artificial Sequence: Synthetic peptide
  Seed: EDLTVKIGDFGLATMKSRW (BRAF V600M)
  Core: DFGLATMKS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EDLTVKIGXFGXAXMKXRW

SEQ ID NO: 25544 - protein, 20 aa, Artificial Sequence
  Description of Artificial Sequence: Synthetic peptide
  Seed: EDLTVKIGDFGLATMKSRWS (BRAF V600M)
  Core: DFGLATMKS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EDLTVKIGXFGXAXMKXRWS

SEQ ID NO: 25545 - protein, 21 aa, Artificial Sequence
  Description of Artificial Sequence: Synthetic peptide
  Seed: EDLTVKIGDFGLATMKSRWSG (BRAF V600M)
  Core: DFGLATMKS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EDLTVKIGXFGXAXMKXRWSG

SEQ ID NO: 25546 - protein, 22 aa, Artificial Sequence
  Description of Artificial Sequence: Synthetic peptide
  Seed: EDLTVKIGDFGLATMKSRWSGS (BRAF V600M)
  Core: DFGLATMKS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EDLTVKIGXFGXAXMKXRWSGS

SEQ ID NO: 25547 - protein, 23 aa, Artificial Sequence
  Description of Artificial Sequence: Synthetic peptide
  Seed: EDLTVKIGDFGLATMKSRWSGSH (BRAF V600M)
  Core: DFGLATMKS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EDLTVKIGXFGXAXMKXRWSGSH

SEQ ID NO: 25548 - protein, 24 aa, Artificial Sequence
  Description of Artificial Sequence: Synthetic peptide
  Seed: EDLTVKIGDFGLATMKSRWSGSHQ (BRAF V600M)
  Core: DFGLATMKS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EDLTVKIGXFGXAXMKXRWSGSHQ

SEQ ID NO: 25549 - protein, 25 aa, Artificial Sequence
  Description of Artificial Sequence: Synthetic peptide
  Seed: EDLTVKIGDFGLATMKSRWSGSHQF (BRAF V600M)
  Core: DFGLATMKS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EDLTVKIGXFGXAXMKXRWSGSHQF

SEQ ID NO: 25550 - protein, 14 aa, Artificial Sequence
  Description of Artificial Sequence: Synthetic peptide
  Seed: FGLATMKSRWSGSH (BRAF V600M)
  Core: ATMKSRWSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FGLXTMXSXWSXSH

SEQ ID NO: 25551 - protein, 15 aa, Artificial Sequence
  Description of Artificial Sequence: Synthetic peptide
  Seed: FGLATMKSRWSGSHQ (BRAF V600M)
  Core: ATMKSRWSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FGLXTMXSXWSXSHQ

SEQ ID NO: 25552 - protein, 16 aa, Artificial Sequence
  Description of Artificial Sequence: Synthetic peptide
  Seed: FGLATMKSRWSGSHQF (BRAF V600M)
  Core: ATMKSRWSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FGLXTMXSXWSXSHQF

SEQ ID NO: 25553 - protein, 17 aa, Artificial Sequence
  Description of Artificial Sequence: Synthetic peptide
  Seed: FGLATMKSRWSGSHQFE (BRAF V600M)
  Core: ATMKSRWSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FGLXTMXSXWSXSHQFE

SEQ ID NO: 25554 - protein, 19 aa, Artificial Sequence
  Description of Artificial Sequence: Synthetic peptide
  Seed: FGLATMKSRWSGSHQFEQL (BRAF V600M)
  Core: ATMKSRWSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FGLXTMXSXWSXSHQFEQL

SEQ ID NO: 25555 - protein, 20 aa, Artificial Sequence
  Description of Artificial Sequence: Synthetic peptide
  Seed: FGLATMKSRWSGSHQFEQLS (BRAF V600M)
  Core: ATMKSRWSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FGLXTMXSXWSXSHQFEQLS

SEQ ID NO: 25556 - protein, 21 aa, Artificial Sequence
  Description of Artificial Sequence: Synthetic peptide
  Seed: FGLATMKSRWSGSHQFEQLSG (BRAF V600M)
  Core: ATMKSRWSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FGLXTMXSXWSXSHQFEQLSG

SEQ ID NO: 25557 - protein, 22 aa, Artificial Sequence
  Description of Artificial Sequence: Synthetic peptide
  Seed: FGLATMKSRWSGSHQFEQLSGS (BRAF V600M)
  Core: ATMKSRWSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FGLXTMXSXWSXSHQFEQLSGS

SEQ ID NO: 25558 - protein, 23 aa, Artificial Sequence
  Description of Artificial Sequence: Synthetic peptide
  Seed: FGLATMKSRWSGSHQFEQLSGSI (BRAF V600M)
  Core: ATMKSRWSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FGLXTMXSXWSXSHQFEQLSGSI

SEQ ID NO: 25559 - protein, 24 aa, Artificial Sequence
  Description of Artificial Sequence: Synthetic peptide
  Seed: FGLATMKSRWSGSHQFEQLSGSIL (BRAF V600M)
  Core: ATMKSRWSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FGLXTMXSXWSXSHQFEQLSGSIL

SEQ ID NO: 25560 - protein, 25 aa, Artificial Sequence
  Description of Artificial Sequence: Synthetic peptide
  Seed: FGLATMKSRWSGSHQFEQLSGSILW (BRAF V600M)
  Core: ATMKSRWSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FGLXTMXSXWSXSHQFEQLSGSILW

SEQ ID NO: 25561 - protein, 23 aa, Artificial Sequence
  Description of Artificial Sequence: Synthetic peptide
  Seed: FLHEDLTVKIGDFGLATMKSRWS (BRAF V600M)
  Core: DFGLATMKS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
FLHEDLTVKIGXFGXAXMKXRWS

SEQ ID NO: 25562 - protein, 24 aa, Artificial Sequence
  Description of Artificial Sequence: Synthetic peptide
  Seed: FLHEDLTVKIGDFGLATMKSRWSG (BRAF V600M)
  Core: DFGLATMKS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
FLHEDLTVKIGXFGXAXMKXRWSG

SEQ ID NO: 25563 - protein, 25 aa, Artificial Sequence
  Description of Artificial Sequence: Synthetic peptide
  Seed: FLHEDLTVKIGDFGLATMKSRWSGS (BRAF V600M)
  Core: DFGLATMKS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
FLHEDLTVKIGXFGXAXMKXRWSGS

SEQ ID NO: 25564 - protein, 19 aa, Artificial Sequence
  Description of Artificial Sequence: Synthetic peptide
  Seed: GDFGLATMKSRWSGSHQFE (BRAF V600M)
  Core: ATMKSRWSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDFGLXTMXSXWSXSHQFE

SEQ ID NO: 25565 - protein, 20 aa, Artificial Sequence
  Description of Artificial Sequence: Synthetic peptide
  Seed: GDFGLATMKSRWSGSHQFEQ (BRAF V600M)
  Core: ATMKSRWSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDFGLXTMXSXWSXSHQFEQ

SEQ ID NO: 25566 - protein, 21 aa, Artificial Sequence
  Description of Artificial Sequence: Synthetic peptide
  Seed: GDFGLATMKSRWSGSHQFEQL (BRAF V600M)
  Core: ATMKSRWSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDFGLXTMXSXWSXSHQFEQL

SEQ ID NO: 25567 - protein, 22 aa, Artificial Sequence
  Description of Artificial Sequence: Synthetic peptide
  Seed: GDFGLATMKSRWSGSHQFEQLS (BRAF V600M)
  Core: ATMKSRWSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDFGLXTMXSXWSXSHQFEQLS

SEQ ID NO: 25568 - protein, 23 aa, Artificial Sequence
  Description of Artificial Sequence: Synthetic peptide
  Seed: GDFGLATMKSRWSGSHQFEQLSG (BRAF V600M)
  Core: ATMKSRWSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDFGLXTMXSXWSXSHQFEQLSG

SEQ ID NO: 25569 - protein, 24 aa, Artificial Sequence
  Description of Artificial Sequence: Synthetic peptide
  Seed: GDFGLATMKSRWSGSHQFEQLSGS (BRAF V600M)
  Core: ATMKSRWSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDFGLXTMXSXWSXSHQFEQLSGS

SEQ ID NO: 25570 - protein, 25 aa, Artificial Sequence
  Description of Artificial Sequence: Synthetic peptide
  Seed: GDFGLATMKSRWSGSHQFEQLSGSI (BRAF V600M)
  Core: ATMKSRWSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDFGLXTMXSXWSXSHQFEQLSGSI

SEQ ID NO: 25571 - protein, 14 aa, Artificial Sequence
  Description of Artificial Sequence: Synthetic peptide
  Seed: GLATMKSRWSGSHQ (BRAF V600M)
  Core: ATMKSRWSG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GLXTMXSXWSXSHQ

SEQ ID NO: 25572 - protein, 15 aa, Artificial Sequence
  Description of Artificial Sequence: Synthetic peptide
  Seed: GLATMKSRWSGSHQF (BRAF V600M)
  Core: ATMKSRWSG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GLXTMXSXWSXSHQF

SEQ ID NO: 25573 - protein, 16 aa, Artificial Sequence
  Description of Artificial Sequence: Synthetic peptide
  Seed: GLATMKSRWSGSHQFE (BRAF V600M)
  Core: ATMKSRWSG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GLXTMXSXWSXSHQFE

SEQ ID NO: 25574 - protein, 17 aa, Artificial Sequence
  Description of Artificial Sequence: Synthetic peptide
  Seed: GLATMKSRWSGSHQFEQ (BRAF V600M)
  Core: ATMKSRWSG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GLXTMXSXWSXSHQFEQ

SEQ ID NO: 25575 - protein, 20 aa, Artificial Sequence
  Description of Artificial Sequence: Synthetic peptide
  Seed: GLATMKSRWSGSHQFEQLSG (BRAF V600M)
  Core: ATMKSRWSG
  misc_feature (3)..(3): Xaa can be Ala, Cys, Asp, Glu, Phe, Gly, His, Ile, Lys, Leu, Met, Asn, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GLXTMXSXWSXSHQFEQLSG

SEQ ID NO: 25576 - protein, 20 aa, Artificial Sequence
  Description of Artificial Sequence: Synthetic peptide
  Seed: HEDLTVKIGDFGLATMKSRW (BRAF V600M)
  Core: DFGLATMKS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HEDLTVKIGXFGXAXMKXRW

SEQ ID NO: 25577 - protein, 21 aa, Artificial Sequence
  Description of Artificial Sequence: Synthetic peptide
  Seed: HEDLTVKIGDFGLATMKSRWS (BRAF V600M)
  Core: DFGLATMKS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HEDLTVKIGXFGXAXMKXRWS

SEQ ID NO: 25578 - protein, 22 aa, Artificial Sequence
  Description of Artificial Sequence: Synthetic peptide
  Seed: HEDLTVKIGDFGLATMKSRWSG (BRAF V600M)
  Core: DFGLATMKS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HEDLTVKIGXFGXAXMKXRWSG

SEQ ID NO: 25579 - protein, 23 aa, Artificial Sequence
  Description of Artificial Sequence: Synthetic peptide
  Seed: HEDLTVKIGDFGLATMKSRWSGS (BRAF V600M)
  Core: DFGLATMKS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HEDLTVKIGXFGXAXMKXRWSGS

SEQ ID NO: 25580 - protein, 24 aa, Artificial Sequence
  Description of Artificial Sequence: Synthetic peptide
  Seed: HEDLTVKIGDFGLATMKSRWSGSH (BRAF V600M)
  Core: DFGLATMKS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HEDLTVKIGXFGXAXMKXRWSGSH

SEQ ID NO: 25581 - protein, 25 aa, Artificial Sequence
  Description of Artificial Sequence: Synthetic peptide
  Seed: HEDLTVKIGDFGLATMKSRWSGSHQ (BRAF V600M)
  Core: DFGLATMKS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HEDLTVKIGXFGXAXMKXRWSGSHQ

SEQ ID NO: 25582 - protein, 24 aa, Artificial Sequence
  Description of Artificial Sequence: Synthetic peptide
  Seed: IFLHEDLTVKIGDFGLATMKSRWS (BRAF V600M)
  Core: DFGLATMKS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IFLHEDLTVKIGXFGXAXMKXRWS

SEQ ID NO: 25583 - protein, 25 aa, Artificial Sequence
  Description of Artificial Sequence: Synthetic peptide
  Seed: IFLHEDLTVKIGDFGLATMKSRWSG (BRAF V600M)
  Core: DFGLATMKS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IFLHEDLTVKIGXFGXAXMKXRWSG

SEQ ID NO: 25584 - protein, 14 aa, Artificial Sequence
  Description of Artificial Sequence: Synthetic peptide
  Seed: IGDFGLATMKSRWS (BRAF V600M)
  Core: DFGLATMKS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IGXFGXAXMKXRWS

SEQ ID NO: 25585 - protein, 19 aa, Artificial Sequence
  Description of Artificial Sequence: Synthetic peptide
  Seed: IGDFGLATMKSRWSGSHQF (BRAF V600M)
  Core: ATMKSRWSG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGDFGLXTMXSXWSXSHQF

SEQ ID NO: 25586 - protein, 20 aa, Artificial Sequence
  Description of Artificial Sequence: Synthetic peptide
  Seed: IGDFGLATMKSRWSGSHQFE (BRAF V600M)
  Core: ATMKSRWSG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGDFGLXTMXSXWSXSHQFE

SEQ ID NO: 25587 - protein, 21 aa, Artificial Sequence
  Description of Artificial Sequence: Synthetic peptide
  Seed: IGDFGLATMKSRWSGSHQFEQ (BRAF V600M)
  Core: ATMKSRWSG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGDFGLXTMXSXWSXSHQFEQ

SEQ ID NO: 25588 - protein, 22 aa, Artificial Sequence
  Description of Artificial Sequence: Synthetic peptide
  Seed: IGDFGLATMKSRWSGSHQFEQL (BRAF V600M)
  Core: ATMKSRWSG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGDFGLXTMXSXWSXSHQFEQL

SEQ ID NO: 25589 - protein, 23 aa, Artificial Sequence
  Description of Artificial Sequence: Synthetic peptide
  Seed: IGDFGLATMKSRWSGSHQFEQLS (BRAF V600M)
  Core: ATMKSRWSG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGDFGLXTMXSXWSXSHQFEQLS

SEQ ID NO: 25590 - protein, 14 aa, Artificial Sequence
  Description of Artificial Sequence: Synthetic peptide
  Seed: KIGDFGLATMKSRW (BRAF V600M)
  Core: DFGLATMKS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KIGXFGXAXMKXRW

SEQ ID NO: 25591 - protein, 15 aa, Artificial Sequence
  Description of Artificial Sequence: Synthetic peptide
  Seed: KIGDFGLATMKSRWS (BRAF V600M)
  Core: DFGLATMKS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KIGXFGXAXMKXRWS

SEQ ID NO: 25592 - protein, 16 aa, Artificial Sequence
  Description of Artificial Sequence: Synthetic peptide
  Seed: KIGDFGLATMKSRWSG (BRAF V600M)
  Core: DFGLATMKS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KIGXFGXAXMKXRWSG

SEQ ID NO: 25593 - protein, 17 aa, Artificial Sequence
  Description of Artificial Sequence: Synthetic peptide
  Seed: KIGDFGLATMKSRWSGS (BRAF V600M)
  Core: DFGLATMKS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KIGXFGXAXMKXRWSGS

SEQ ID NO: 25594 - protein, 19 aa, Artificial Sequence
  Description of Artificial Sequence: Synthetic peptide
  Seed: KIGDFGLATMKSRWSGSHQ (BRAF V600M)
  Core: ATMKSRWSG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KIGDFGLXTMXSXWSXSHQ

SEQ ID NO: 25595 - protein, 20 aa, Artificial Sequence
  Description of Artificial Sequence: Synthetic peptide
  Seed: KIGDFGLATMKSRWSGSHQF (BRAF V600M)
  Core: ATMKSRWSG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KIGDFGLXTMXSXWSXSHQF

SEQ ID NO: 25596 - protein, 20 aa, Artificial Sequence
  Description of Artificial Sequence: Synthetic peptide
  Seed: LHEDLTVKIGDFGLATMKSR (BRAF V600M)
  Core: DFGLATMKS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LHEDLTVKIGXFGXAXMKXR

SEQ ID NO: 25597 - protein, 22 aa, Artificial Sequence
  Description of Artificial Sequence: Synthetic peptide
  Seed: LHEDLTVKIGDFGLATMKSRWS (BRAF V600M)
  Core: DFGLATMKS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LHEDLTVKIGXFGXAXMKXRWS

SEQ ID NO: 25598 - protein, 23 aa, Artificial Sequence
  Description of Artificial Sequence: Synthetic peptide
  Seed: LHEDLTVKIGDFGLATMKSRWSG (BRAF V600M)
  Core: DFGLATMKS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LHEDLTVKIGXFGXAXMKXRWSG

SEQ ID NO: 25599 - protein, 24 aa, Artificial Sequence
  Description of Artificial Sequence: Synthetic peptide
  Seed: LHEDLTVKIGDFGLATMKSRWSGS (BRAF V600M)
  Core: DFGLATMKS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LHEDLTVKIGXFGXAXMKXRWSGS

SEQ ID NO: 25600 - protein, 25 aa, Artificial Sequence
  Description of Artificial Sequence: Synthetic peptide
  Seed: LHEDLTVKIGDFGLATMKSRWSGSH (BRAF V600M)
  Core: DFGLATMKS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LHEDLTVKIGXFGXAXMKXRWSGSH

SEQ ID NO: 25601 - protein, 16 aa, Artificial Sequence
  Description of Artificial Sequence: Synthetic peptide
  Seed: LTVKIGDFGLATMKSR (BRAF V600M)
  Core: DFGLATMKS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LTVKIGXFGXAXMKXR

SEQ ID NO: 25602 - protein, 17 aa, Artificial Sequence
  Description of Artificial Sequence: Synthetic peptide
  Seed: LTVKIGDFGLATMKSRW (BRAF V600M)
  Core: DFGLATMKS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LTVKIGXFGXAXMKXRW

SEQ ID NO: 25603 - protein, 18 aa, Artificial Sequence
  Description of Artificial Sequence: Synthetic peptide
  Seed: LTVKIGDFGLATMKSRWS (BRAF V600M)
  Core: DFGLATMKS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LTVKIGXFGXAXMKXRWS

SEQ ID NO: 25604 - protein, 19 aa, Artificial Sequence
  Description of Artificial Sequence: Synthetic peptide
  Seed: LTVKIGDFGLATMKSRWSG (BRAF V600M)
  Core: DFGLATMKS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LTVKIGXFGXAXMKXRWSG

SEQ ID NO: 25605 - protein, 20 aa, Artificial Sequence
  Description of Artificial Sequence: Synthetic peptide
  Seed: LTVKIGDFGLATMKSRWSGS (BRAF V600M)
  Core: DFGLATMKS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LTVKIGXFGXAXMKXRWSGS

SEQ ID NO: 25606 - protein, 21 aa, Artificial Sequence
  Description of Artificial Sequence: Synthetic peptide
  Seed: LTVKIGDFGLATMKSRWSGSH (BRAF V600M)
  Core: DFGLATMKS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LTVKIGXFGXAXMKXRWSGSH

SEQ ID NO: 25607 - protein, 25 aa, Artificial Sequence
  Description of Artificial Sequence: Synthetic peptide
  Seed: NIFLHEDLTVKIGDFGLATMKSRWS (BRAF V600M)
  Core: DFGLATMKS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
NIFLHEDLTVKIGXFGXAXMKXRWS

SEQ ID NO: 25608 - protein, 15 aa, Artificial Sequence
  Description of Artificial Sequence: Synthetic peptide
  Seed: TVKIGDFGLATMKSR (BRAF V600M)
  Core: DFGLATMKS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TVKIGXFGXAXMKXR

SEQ ID NO: 25609 - protein, 16 aa, Artificial Sequence
  Description of Artificial Sequence: Synthetic peptide
  Seed: TVKIGDFGLATMKSRW (BRAF V600M)
  Core: DFGLATMKS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TVKIGXFGXAXMKXRW

SEQ ID NO: 25610 - protein, 17 aa, Artificial Sequence
  Description of Artificial Sequence: Synthetic peptide
  Seed: TVKIGDFGLATMKSRWS (BRAF V600M)
  Core: DFGLATMKS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TVKIGXFGXAXMKXRWS

SEQ ID NO: 25611 - protein, 19 aa, Artificial Sequence
  Description of Artificial Sequence: Synthetic peptide
  Seed: TVKIGDFGLATMKSRWSGS (BRAF V600M)
  Core: DFGLATMKS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TVKIGXFGXAXMKXRWSGS

SEQ ID NO: 25612 - protein, 14 aa, Artificial Sequence
  Description of Artificial Sequence: Synthetic peptide
  Seed: VKIGDFGLATMKSR (BRAF V600M)
  Core: DFGLATMKS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKIGXFGXAXMKXR

SEQ ID NO: 25613 - protein, 15 aa, Artificial Sequence
  Description of Artificial Sequence: Synthetic peptide
  Seed: VKIGDFGLATMKSRW (BRAF V600M)
  Core: DFGLATMKS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKIGXFGXAXMKXRW

SEQ ID NO: 25614 - protein, 16 aa, Artificial Sequence
  Description of Artificial Sequence: Synthetic peptide
  Seed: VKIGDFGLATMKSRWS (BRAF V600M)
  Core: DFGLATMKS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKIGXFGXAXMKXRWS

SEQ ID NO: 25615 - protein, 17 aa, Artificial Sequence
  Description of Artificial Sequence: Synthetic peptide
  Seed: VKIGDFGLATMKSRWSG (BRAF V600M)
  Core: DFGLATMKS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKIGXFGXAXMKXRWSG

SEQ ID NO: 25616 - protein, 20 aa, Artificial Sequence
  Description of Artificial Sequence: Synthetic peptide
  Seed: VKIGDFGLATMKSRWSGSHQ (BRAF V600M)
  Core: ATMKSRWSG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VKIGDFGLXTMXSXWSXSHQ

SEQ ID NO: 25617 - protein, 20 aa, Artificial Sequence
  Description of Artificial Sequence: Synthetic peptide
  Seed: DVNPEGKYSFGVTCVKKCPR (EGFR A289V)
  Core: FGVTCVKKC
  misc_feature (10)..(10): Xaa can be Ala, Cys, Glu, Phe, His, Ile, Leu, Met, Pro, Gln, Arg, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DVNPEGKYSXGVXCXKKXPR

SEQ ID NO: 25618 - protein, 23 aa, Artificial Sequence
  Description of Artificial Sequence: Synthetic peptide
  Seed: DVNPEGKYSFGVTCVKKCPRNYV (EGFR A289V)
  Core: FGVTCVKKC
  misc_feature (10)..(10): Xaa can be Cys, Phe, His, Ile, Leu, Met, Gln, Arg, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DVNPEGKYSXGVXCXKKXPRNYV

SEQ ID NO: 25619 - protein, 24 aa, Artificial Sequence
  Description of Artificial Sequence: Synthetic peptide
  Seed: DVNPEGKYSFGVTCVKKCPRNYVV (EGFR A289V)
  Core: FGVTCVKKC
  misc_feature (10)..(10): Xaa can be Phe, His, Ile, Leu, Met, Gln, Arg, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DVNPEGKYSXGVXCXKKXPRNYVV

SEQ ID NO: 25620 - protein, 25 aa, Artificial Sequence
  Description of Artificial Sequence: Synthetic peptide
  Seed: DVNPEGKYSFGVTCVKKCPRNYVVT (EGFR A289V)
  Core: FGVTCVKKC
  misc_feature (10)..(10): Xaa can be Phe, His, Ile, Leu, Met, Arg, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DVNPEGKYSXGVXCXKKXPRNYVVT

SEQ ID NO: 25621 - protein, 15 aa, Artificial Sequence
  Description of Artificial Sequence: Synthetic peptide
  Seed: EGKYSFGVTCVKKCP (EGFR A289V)
  Core: YSFGVTCVK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EGKXSFXVXCVXKCP

SEQ ID NO: 25622 - protein, 15 aa, Artificial Sequence
  Description of Artificial Sequence: Synthetic peptide
  Seed: EGKYSFGVTCVKKCP (EGFR A289V)
  Core: FGVTCVKKC
  misc_feature (6)..(6): Xaa can be Ala, Cys, Asp, Glu, Phe, Gly, His, Ile, Lys, Leu, Met, Asn, Pro, Gln, Arg, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EGKYSXGVXCXKKXP

SEQ ID NO: 25623 - protein, 17 aa, Artificial Sequence
  Description of Artificial Sequence: Synthetic peptide
  Seed: EGKYSFGVTCVKKCPRN (EGFR A289V)
  Core: FGVTCVKKC
  misc_feature (6)..(6): Xaa can be Ala, Cys, Phe, His, Ile, Leu, Met, Gln, Arg, Thr, Val, Trp, or Tyr
  misc_feature (9)..(9): Xaa can be Ala, Cys, Asp, Glu, Phe, Gly, His, Ile, Leu, Met, Asn, Gln, Arg, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EGKYSXGVXCXKKXPRN

SEQ ID NO: 25624 - protein, 20 aa, Artificial Sequence
  Description of Artificial Sequence: Synthetic peptide
  Seed: EGKYSFGVTCVKKCPRNYVV (EGFR A289V)
  Core: FGVTCVKKC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EGKYSXGVXCXKKXPRNYVV

SEQ ID NO: 25625 - protein, 15 aa, Artificial Sequence
  Description of Artificial Sequence: Synthetic peptide
  Seed: GKYSFGVTCVKKCPR (EGFR A289V)
  Core: FGVTCVKKC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GKYSXGVXCXKKXPR

SEQ ID NO: 25626 - protein, 20 aa, Artificial Sequence
  Description of Artificial Sequence: Synthetic peptide
  Seed: GKYSFGVTCVKKCPRNYVVT (EGFR A289V)
  Core: FGVTCVKKC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GKYSXGVXCXKKXPRNYVVT

SEQ ID NO: 25627 - protein, 15 aa, Artificial Sequence
  Description of Artificial Sequence: Synthetic peptide
  Seed: KYSFGVTCVKKCPRN (EGFR A289V)
  Core: FGVTCVKKC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KYSXGVXCXKKXPRN

SEQ ID NO: 25628 - protein, 20 aa, Artificial Sequence
  Description of Artificial Sequence: Synthetic peptide
  Seed: MDVNPEGKYSFGVTCVKKCP (EGFR A289V)
  Core: GKYSFGVTC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MDVNPEXKYXFXVTXVKKCP

SEQ ID NO: 25629 - protein, 20 aa, Artificial Sequence
  Description of Artificial Sequence: Synthetic peptide
  Seed: MDVNPEGKYSFGVTCVKKCP (EGFR A289V)
  Core: YSFGVTCVK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MDVNPEGKXSFXVXCVXKCP

SEQ ID NO: 25630 - protein, 23 aa, Artificial Sequence
  Description of Artificial Sequence: Synthetic peptide
  Seed: MDVNPEGKYSFGVTCVKKCPRNY (EGFR A289V)
  Core: FGVTCVKKC
  misc_feature (11)..(11): Xaa can be Phe, Ile, Leu, Met, Gln, Arg, Thr, Val, Trp, or Tyr
  misc_feature (14)..(14): Xaa can be Ala, Cys, Asp, Glu, Phe, Gly, His, Ile, Leu, Met, Asn, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MDVNPEGKYSXGVXCXKKXPRNY

SEQ ID NO: 25631 - protein, 24 aa, Artificial Sequence
  Description of Artificial Sequence: Synthetic peptide
  Seed: MDVNPEGKYSFGVTCVKKCPRNYV (EGFR A289V)
  Core: FGVTCVKKC
  misc_feature (11)..(11): Xaa can be Cys, Phe, His, Ile, Leu, Met, Gln, Arg, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MDVNPEGKYSXGVXCXKKXPRNYV

SEQ ID NO: 25632 - protein, 25 aa, Artificial Sequence
  Description of Artificial Sequence: Synthetic peptide
  Seed: MDVNPEGKYSFGVTCVKKCPRNYVV (EGFR A289V)
  Core: FGVTCVKKC
  misc_feature (11)..(11): Xaa can be Phe, His, Ile, Leu, Met, Arg, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MDVNPEGKYSXGVXCXKKXPRNYVV

SEQ ID NO: 25633 - protein, 15 aa, Artificial Sequence
  Description of Artificial Sequence: Synthetic peptide
  Seed: NPEGKYSFGVTCVKK (EGFR A289V)
  Core: GKYSFGVTC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NPEXKYXFXVTXVKK

SEQ ID NO: 25634 - protein, 15 aa, Artificial Sequence
  Description of Artificial Sequence: Synthetic peptide
  Seed: NPEGKYSFGVTCVKK (EGFR A289V)
  Core: YSFGVTCVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NPEGKXSFXVXCVXK

SEQ ID NO: 25635 - protein, 20 aa, Artificial Sequence
  Description of Artificial Sequence: Synthetic peptide
  Seed: NPEGKYSFGVTCVKKCPRNY (EGFR A289V)
  Core: FGVTCVKKC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NPEGKYSXGVXCXKKXPRNY

SEQ ID NO: 25636 - protein, 23 aa, Artificial Sequence
  Description of Artificial Sequence: Synthetic peptide
  Seed: NPEGKYSFGVTCVKKCPRNYVVT (EGFR A289V)
  Core: FGVTCVKKC
  misc_feature (8)..(8): Xaa can be Phe, His, Ile, Leu, Met, Arg, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NPEGKYSXGVXCXKKXPRNYVVT

SEQ ID NO: 25637 - protein, 24 aa, Artificial Sequence
  Description of Artificial Sequence: Synthetic peptide
  Seed: NPEGKYSFGVTCVKKCPRNYVVTD (EGFR A289V)
  Core: FGVTCVKKC
  misc_feature (8)..(8): Xaa can be Phe, Ile, Leu, Met, Arg, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NPEGKYSXGVXCXKKXPRNYVVTD

SEQ ID NO: 25638 - protein, 25 aa, Artificial Sequence
  Description of Artificial Sequence: Synthetic peptide
  Seed: NPEGKYSFGVTCVKKCPRNYVVTDH (EGFR A289V)
  Core: FGVTCVKKC
  misc_feature (8)..(8): Xaa can be Phe, Ile, Leu, Met, Arg, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NPEGKYSXGVXCXKKXPRNYVVTDH

SEQ ID NO: 25639 - protein, 15 aa, Artificial Sequence
  Description of Artificial Sequence: Synthetic peptide
  Seed: PEGKYSFGVTCVKKC (EGFR A289V)
  Core: YSFGVTCVK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PEGKXSFXVXCVXKC

SEQ ID NO: 25640 - protein, 17 aa, Artificial Sequence
  Description of Artificial Sequence: Synthetic peptide
  Seed: PEGKYSFGVTCVKKCPR (EGFR A289V)
  Core: FGVTCVKKC
  misc_feature (7)..(7): Xaa can be Phe, His, Ile, Leu, Met, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PEGKYSXGVXCXKKXPR

SEQ ID NO: 25641 - protein, 20 aa, Artificial Sequence
  Description of Artificial Sequence: Synthetic peptide
  Seed: PEGKYSFGVTCVKKCPRNYV (EGFR A289V)
  Core: FGVTCVKKC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PEGKYSXGVXCXKKXPRNYV

SEQ ID NO: 25642 - protein, 20 aa, Artificial Sequence
  Description of Artificial Sequence: Synthetic peptide
  Seed: QMDVNPEGKYSFGVTCVKKC (EGFR A289V)
  Core: GKYSFGVTC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QMDVNPEXKYXFXVTXVKKC

SEQ ID NO: 25643 - protein, 24 aa, Artificial Sequence
  Description of Artificial Sequence: Synthetic peptide
  Seed: QMDVNPEGKYSFGVTCVKKCPRNY (EGFR A289V)
  Core: FGVTCVKKC
  misc_feature (12)..(12): Xaa can be Cys, Phe, Ile, Leu, Met, Gln, Arg, Thr, Val, Trp, or Tyr
  misc_feature (15)..(15): Xaa can be Ala, Cys, Asp, Glu, Phe, Gly, His, Ile, Leu, Met, Asn, Gln, Arg, Ser, Thr, Val, Trp, or Ty r
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QMDVNPEGKYSXGVXCXKKXPRNY

SEQ ID NO: 25644 - protein, 25 aa, Artificial Sequence
  Description of Artificial Sequence: Synthetic peptide
  Seed: QMDVNPEGKYSFGVTCVKKCPRNYV (EGFR A289V)
  Core: FGVTCVKKC
  misc_feature (12)..(12): Xaa can be Phe, His, Ile, Leu, Met, Gln, Arg, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QMDVNPEGKYSXGVXCXKKXPRNYV

SEQ ID NO: 25645 - protein, 24 aa, Artificial Sequence
  Description of Artificial Sequence: Synthetic peptide
  Seed: TYQMDVNPEGKYSFGVTCVKKCPR (EGFR A289V)
  Core: FGVTCVKKC
  misc_feature (14)..(14): Xaa can be Phe, Ile, Leu, Met, Val, Trp, or Tyr
  misc_feature (17)..(17): Xaa can be Ala, Cys, Asp, Glu, Phe, Gly, His, Ile, Lys, Leu, Met, Asn, Gln, Ser, Thr, Val, Trp, or Ty r
  misc_feature (19)..(19): Xaa can be Ala, Cys, Asp, Glu, Phe, Gly, His, Ile, Lys, Leu, Met, Asn, Pro, Gln, Arg, Ser, Thr, Val, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TYQMDVNPEGKYSXGVXCXKKXPR

SEQ ID NO: 25646 - protein, 25 aa, Artificial Sequence
  Description of Artificial Sequence: Synthetic peptide
  Seed: TYQMDVNPEGKYSFGVTCVKKCPRN (EGFR A289V)
  Core: FGVTCVKKC
  misc_feature (14)..(14): Xaa can be Phe, His, Ile, Leu, Met, Arg, Val, Trp, or Tyr
  misc_feature (17)..(17): Xaa can be Ala, Cys, Asp, Glu, Phe, Gly, His, Ile, Lys, Leu, Met, Asn, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TYQMDVNPEGKYSXGVXCXKKXPRN

SEQ ID NO: 25647 - protein, 20 aa, Artificial Sequence
  Description of Artificial Sequence: Synthetic peptide
  Seed: VNPEGKYSFGVTCVKKCPRN (EGFR A289V)
  Core: FGVTCVKKC
  misc_feature (9)..(9): Xaa can be Ala, Cys, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VNPEGKYSXGVXCXKKXPRN

SEQ ID NO: 25648 - protein, 23 aa, Artificial Sequence
  Description of Artificial Sequence: Synthetic peptide
  Seed: VNPEGKYSFGVTCVKKCPRNYVV (EGFR A289V)
  Core: FGVTCVKKC
  misc_feature (9)..(9): Xaa can be Phe, His, Ile, Leu, Met, Gln, Arg, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VNPEGKYSXGVXCXKKXPRNYVV

SEQ ID NO: 25649 - protein, 24 aa, Artificial Sequence
  Description of Artificial Sequence: Synthetic peptide
  Seed: VNPEGKYSFGVTCVKKCPRNYVVT (EGFR A289V)
  Core: FGVTCVKKC
  misc_feature (9)..(9): Xaa can be Phe, His, Ile, Leu, Met, Arg, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VNPEGKYSXGVXCXKKXPRNYVVT

SEQ ID NO: 25650 - protein, 25 aa, Artificial Sequence
  Description of Artificial Sequence: Synthetic peptide
  Seed: VNPEGKYSFGVTCVKKCPRNYVVTD (EGFR A289V)
  Core: FGVTCVKKC
  misc_feature (9)..(9): Xaa can be Phe, His, Ile, Leu, Met, Arg, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VNPEGKYSXGVXCXKKXPRNYVVTD

SEQ ID NO: 25651 - protein, 20 aa, Artificial Sequence
  Description of Artificial Sequence: Synthetic peptide
  Seed: YQMDVNPEGKYSFGVTCVKK (EGFR A289V)
  Core: YSFGVTCVK
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YQMDVNPEGKXSFXVXCVXK

SEQ ID NO: 25652 - protein, 24 aa, Artificial Sequence
  Description of Artificial Sequence: Synthetic peptide
  Seed: YQMDVNPEGKYSFGVTCVKKCPRN (EGFR A289V)
  Core: FGVTCVKKC
  misc_feature (13)..(13): Xaa can be Phe, Ile, Leu, Met, Gln, Thr, Val, Trp, or Tyr
  misc_feature (16)..(16): Xaa can be Ala, Cys, Asp, Glu, Phe, Gly, His, Ile, Leu, Met, Asn, Gln, Arg, Ser, Thr, Val, Trp, or Ty r
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YQMDVNPEGKYSXGVXCXKKXPRN

SEQ ID NO: 25653 - protein, 25 aa, Artificial Sequence
  Description of Artificial Sequence: Synthetic peptide
  Seed: YQMDVNPEGKYSFGVTCVKKCPRNY (EGFR A289V)
  Core: FGVTCVKKC
  misc_feature (13)..(13): Xaa can be Phe, Ile, Leu, Met, Gln, Arg, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YQMDVNPEGKYSXGVXCXKKXPRNY

SEQ ID NO: 25654 - protein, 20 aa, Artificial Sequence
  Description of Artificial Sequence: Synthetic peptide
  Seed: AHYIDGPHCVKTCPAVVMGE (EGFR G598V)
  Core: CVKTCPAVV
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AHYIDGPHXVKXCXAVXMGE

SEQ ID NO: 25655 - protein, 20 aa, Artificial Sequence
  Description of Artificial Sequence: Synthetic peptide
  Seed: AHYIDGPHCVKTCPAVVMGE (EGFR G598V)
  Core: VKTCPAVVM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AHYIDGPHCXKTXPXVVXGE

SEQ ID NO: 25656 - protein, 21 aa, Artificial Sequence
  Description of Artificial Sequence: Synthetic peptide
  Seed: AHYIDGPHCVKTCPAVVMGEN (EGFR G598V)
  Core: CVKTCPAVV
  misc_feature (9)..(9): Xaa can be Ala, Cys, Glu, Phe, His, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AHYIDGPHXVKXCXAVXMGEN

SEQ ID NO: 25657 - protein, 21 aa, Artificial Sequence
  Description of Artificial Sequence: Synthetic peptide
  Seed: AHYIDGPHCVKTCPAVVMGEN (EGFR G598V)
  Core: VKTCPAVVM
  misc_feature (10)..(10): Xaa can be Ala, Cys, Phe, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AHYIDGPHCXKTXPXVVXGEN

SEQ ID NO: 25658 - protein, 22 aa, Artificial Sequence
  Description of Artificial Sequence: Synthetic peptide
  Seed: AHYIDGPHCVKTCPAVVMGENN (EGFR G598V)
  Core: CVKTCPAVV
  misc_feature (9)..(9): Xaa can be Ala, Cys, Glu, Phe, His, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AHYIDGPHXVKXCXAVXMGENN

SEQ ID NO: 25659 - protein, 22 aa, Artificial Sequence
  Description of Artificial Sequence: Synthetic peptide
  Seed: AHYIDGPHCVKTCPAVVMGENN (EGFR G598V)
  Core: VKTCPAVVM
  misc_feature (10)..(10): Xaa can be Ala, Cys, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AHYIDGPHCXKTXPXVVXGENN

SEQ ID NO: 25660 - protein, 23 aa, Artificial Sequence
  Description of Artificial Sequence: Synthetic peptide
  Seed: AHYIDGPHCVKTCPAVVMGENNT (EGFR G598V)
  Core: CVKTCPAVV
  misc_feature (9)..(9): Xaa can be Ala, Cys, Glu, Phe, His, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AHYIDGPHXVKXCXAVXMGENNT

SEQ ID NO: 25661 - protein, 23 aa, Artificial Sequence
  Description of Artificial Sequence: Synthetic peptide
  Seed: AHYIDGPHCVKTCPAVVMGENNT (EGFR G598V)
  Core: VKTCPAVVM
  misc_feature (10)..(10): Xaa can be Ala, Cys, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AHYIDGPHCXKTXPXVVXGENNT

SEQ ID NO: 25662 - protein, 24 aa, Artificial Sequence
  Description of Artificial Sequence: Synthetic peptide
  Seed: AHYIDGPHCVKTCPAVVMGENNTL (EGFR G598V)
  Core: CVKTCPAVV
  misc_feature (9)..(9): Xaa can be Ala, Cys, Glu, Phe, His, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AHYIDGPHXVKXCXAVXMGENNTL

SEQ ID NO: 25663 - protein, 24 aa, Artificial Sequence
  Description of Artificial Sequence: Synthetic peptide
  Seed: AHYIDGPHCVKTCPAVVMGENNTL (EGFR G598V)
  Core: VKTCPAVVM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AHYIDGPHCXKTXPXVVXGENNTL

SEQ ID NO: 25664 - protein, 25 aa, Artificial Sequence
  Description of Artificial Sequence: Synthetic peptide
  Seed: AHYIDGPHCVKTCPAVVMGENNTLV (EGFR G598V)
  Core: CVKTCPAVV
  misc_feature (9)..(9): Xaa can be Ala, Cys, Glu, Phe, His, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AHYIDGPHXVKXCXAVXMGENNTLV

SEQ ID NO: 25665 - protein, 25 aa, Artificial Sequence
  Description of Artificial Sequence: Synthetic peptide
  Seed: AHYIDGPHCVKTCPAVVMGENNTLV (EGFR G598V)
  Core: VKTCPAVVM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AHYIDGPHCXKTXPXVVXGENNTLV

SEQ ID NO: 25666 - protein, 20 aa, Artificial Sequence
  Description of Artificial Sequence: Synthetic peptide
  Seed: CAHYIDGPHCVKTCPAVVMG (EGFR G598V)
  Core: CVKTCPAVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CAHYIDGPHXVKXCXAVXMG

SEQ ID NO: 25667 - protein, 20 aa, Artificial Sequence
  Description of Artificial Sequence: Synthetic peptide
  Seed: CAHYIDGPHCVKTCPAVVMG (EGFR G598V)
  Core: VKTCPAVVM
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CAHYIDGPHCXKTXPXVVXG

SEQ ID NO: 25668 - protein, 21 aa, Artificial Sequence
  Description of Artificial Sequence: Synthetic peptide
  Seed: CAHYIDGPHCVKTCPAVVMGE (EGFR G598V)
  Core: CVKTCPAVV
  misc_feature (10)..(10): Xaa can be Ala, Cys, Phe, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CAHYIDGPHXVKXCXAVXMGE

SEQ ID NO: 25669 - protein, 22 aa, Artificial Sequence
  Description of Artificial Sequence: Synthetic peptide
  Seed: CAHYIDGPHCVKTCPAVVMGEN (EGFR G598V)
  Core: CVKTCPAVV
  misc_feature (10)..(10): Xaa can be Ala, Cys, Glu, Phe, His, Ile, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CAHYIDGPHXVKXCXAVXMGEN

SEQ ID NO: 25670 - protein, 22 aa, Artificial Sequence
  Description of Artificial Sequence: Synthetic peptide
  Seed: CAHYIDGPHCVKTCPAVVMGEN (EGFR G598V)
  Core: VKTCPAVVM
  misc_feature (11)..(11): Xaa can be Ala, Cys, Phe, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CAHYIDGPHCXKTXPXVVXGEN

SEQ ID NO: 25671 - protein, 23 aa, Artificial Sequence
  Description of Artificial Sequence: Synthetic peptide
  Seed: CAHYIDGPHCVKTCPAVVMGENN (EGFR G598V)
  Core: CVKTCPAVV
  misc_feature (10)..(10): Xaa can be Ala, Cys, Glu, Phe, His, Ile, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CAHYIDGPHXVKXCXAVXMGENN

SEQ ID NO: 25672 - protein, 23 aa, Artificial Sequence
  Description of Artificial Sequence: Synthetic peptide
  Seed: CAHYIDGPHCVKTCPAVVMGENN (EGFR G598V)
  Core: VKTCPAVVM
  misc_feature (11)..(11): Xaa can be Ala, Cys, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CAHYIDGPHCXKTXPXVVXGENN

SEQ ID NO: 25673 - protein, 24 aa, Artificial Sequence
  Description of Artificial Sequence: Synthetic peptide
  Seed: CAHYIDGPHCVKTCPAVVMGENNT (EGFR G598V)
  Core: CVKTCPAVV
  misc_feature (10)..(10): Xaa can be Ala, Cys, Glu, Phe, His, Ile, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CAHYIDGPHXVKXCXAVXMGENNT

SEQ ID NO: 25674 - protein, 24 aa, Artificial Sequence
  Description of Artificial Sequence: Synthetic peptide
  Seed: CAHYIDGPHCVKTCPAVVMGENNT (EGFR G598V)
  Core: VKTCPAVVM
  misc_feature (11)..(11): Xaa can be Ala, Cys, Glu, Phe, Gly, His, Ile, Lys, Leu, Met, Asn, Gln, Arg, Ser, Thr, Val, Trp, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CAHYIDGPHCXKTXPXVVXGENNT

SEQ ID NO: 25675 - protein, 25 aa, Artificial Sequence
  Description of Artificial Sequence: Synthetic peptide
  Seed: CAHYIDGPHCVKTCPAVVMGENNTL (EGFR G598V)
  Core: CVKTCPAVV
  misc_feature (10)..(10): Xaa can be Ala, Cys, Glu, Phe, His, Ile, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CAHYIDGPHXVKXCXAVXMGENNTL

SEQ ID NO: 25676 - protein, 25 aa, Artificial Sequence
  Description of Artificial Sequence: Synthetic peptide
  Seed: CAHYIDGPHCVKTCPAVVMGENNTL (EGFR G598V)
  Core: VKTCPAVVM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CAHYIDGPHCXKTXPXVVXGENNTL

SEQ ID NO: 25677 - protein, 23 aa, Artificial Sequence
  Description of Artificial Sequence: Synthetic peptide
  Seed: CIQCAHYIDGPHCVKTCPAVVMG (EGFR G598V)
  Core: CVKTCPAVV
  misc_feature (13)..(13): Xaa can be Ala, Cys, Glu, Phe, His, Ile, Lys, Leu, Met, Asn, Pro, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CIQCAHYIDGPHXVKXCXAVXMG

SEQ ID NO: 25678 - protein, 24 aa, Artificial Sequence
  Description of Artificial Sequence: Synthetic peptide
  Seed: CIQCAHYIDGPHCVKTCPAVVMGE (EGFR G598V)
  Core: CVKTCPAVV
  misc_feature (13)..(13): Xaa can be Ala, Cys, Glu, Phe, His, Ile, Lys, Leu, Met, Asn, Pro, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CIQCAHYIDGPHXVKXCXAVXMGE

SEQ ID NO: 25679 - protein, 24 aa, Artificial Sequence
  Description of Artificial Sequence: Synthetic peptide
  Seed: CIQCAHYIDGPHCVKTCPAVVMGE (EGFR G598V)
  Core: VKTCPAVVM
  misc_feature (14)..(14): Xaa can be Ala, Cys, Phe, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CIQCAHYIDGPHCXKTXPXVVXGE

SEQ ID NO: 25680 - protein, 25 aa, Artificial Sequence
  Description of Artificial Sequence: Synthetic peptide
  Seed: CIQCAHYIDGPHCVKTCPAVVMGEN (EGFR G598V)
  Core: CVKTCPAVV
  misc_feature (13)..(13): Xaa can be Ala, Cys, Glu, Phe, His, Ile, Leu, Met, Asn, Pro, Gln, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CIQCAHYIDGPHXVKXCXAVXMGEN

SEQ ID NO: 25681 - protein, 25 aa, Artificial Sequence
  Description of Artificial Sequence: Synthetic peptide
  Seed: CIQCAHYIDGPHCVKTCPAVVMGEN (EGFR G598V)
  Core: VKTCPAVVM
  misc_feature (14)..(14): Xaa can be Ala, Cys, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CIQCAHYIDGPHCXKTXPXVVXGEN

SEQ ID NO: 25682 - protein, 15 aa, Artificial Sequence
  Description of Artificial Sequence: Synthetic peptide
  Seed: CVKTCPAVVMGENNT (EGFR G598V)
  Core: VKTCPAVVM
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
CXKTXPXVVXGENNT

SEQ ID NO: 25683 - protein, 15 aa, Artificial Sequence
  Description of Artificial Sequence: Synthetic peptide
  Seed: CVKTCPAVVMGENNT (EGFR G598V)
  Core: TCPAVVMGE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Phe, Gly, His, Ile, Lys, Leu, Met, Asn, Pro, Gln, Arg, Ser, Thr, Val, Trp, or Ty r
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CVKXCPXVXMGXNNT

SEQ ID NO: 25684 - protein, 16 aa, Artificial Sequence
  Description of Artificial Sequence: Synthetic peptide
  Seed: CVKTCPAVVMGENNTL (EGFR G598V)
  Core: VKTCPAVVM
  misc_feature (2)..(2): Xaa can be Ala, Glu, Phe, Ile, Leu, Met, Pro, Thr, Val, Trp, or Tyr
  misc_feature (5)..(5): Xaa can be Ala, Cys, Gly, Ile, Met, Asn, Ser, Thr, Val, or Trp
  misc_feature (7)..(7): Xaa can be Ala, Cys, Ile, Leu, Met, Pro, Ser, Thr, or Val
  misc_feature (10)..(10): Xaa can be Ala, Cys, Asp, Glu, Phe, Gly, His, Ile, Lys, Leu, Met, Asn, Pro, Gln, Ser, Thr, Val, or Tr p
CXKTXPXVVXGENNTL

SEQ ID NO: 25685 - protein, 15 aa, Artificial Sequence
  Description of Artificial Sequence: Synthetic peptide
  Seed: DGPHCVKTCPAVVMG (EGFR G598V)
  Core: CVKTCPAVV
  misc_feature (5)..(5): Xaa can be Ala, Cys, Asp, Glu, Phe, Gly, His, Ile, Lys, Leu, Met, Asn, Pro, Gln, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DGPHXVKXCXAVXMG

SEQ ID NO: 25686 - protein, 15 aa, Artificial Sequence
  Description of Artificial Sequence: Synthetic peptide
  Seed: DGPHCVKTCPAVVMG (EGFR G598V)
  Core: VKTCPAVVM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGPHCXKTXPXVVXG

SEQ ID NO: 25687 - protein, 16 aa, Artificial Sequence
  Description of Artificial Sequence: Synthetic peptide
  Seed: DGPHCVKTCPAVVMGE (EGFR G598V)
  Core: CVKTCPAVV
  misc_feature (5)..(5): Xaa can be Ala, Cys, Phe, His, Ile, Lys, Leu, Met, Asn, Gln, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DGPHXVKXCXAVXMGE

SEQ ID NO: 25688 - protein, 17 aa, Artificial Sequence
  Description of Artificial Sequence: Synthetic peptide
  Seed: DGPHCVKTCPAVVMGEN (EGFR G598V)
  Core: CVKTCPAVV
  misc_feature (5)..(5): Xaa can be Ala, Cys, Phe, His, Ile, Leu, Met, Asn, Pro, Gln, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Leu, Met, Asn, Pro, Gln, Ser, Thr, Val, Trp, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DGPHXVKXCXAVXMGEN

SEQ ID NO: 25689 - protein, 17 aa, Artificial Sequence
  Description of Artificial Sequence: Synthetic peptide
  Seed: DGPHCVKTCPAVVMGEN (EGFR G598V)
  Core: VKTCPAVVM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGPHCXKTXPXVVXGEN

SEQ ID NO: 25690 - protein, 19 aa, Artificial Sequence
  Description of Artificial Sequence: Synthetic peptide
  Seed: DGPHCVKTCPAVVMGENNT (EGFR G598V)
  Core: VKTCPAVVM
  misc_feature (6)..(6): Xaa can be Ala, Cys, Asp, Glu, Phe, His, Ile, Lys, Leu, Met, Asn, Pro, Gln, Arg, Ser, Thr, Val, Trp, or Tyr
  misc_feature (9)..(9): Xaa can be Ala, Cys, Glu, Phe, Gly, His, Ile, Leu, Met, Asn, Gln, Ser, Thr, Val, Trp, or Tyr
  misc_feature (11)..(11): Xaa can be Ala, Cys, Phe, Gly, Ile, Leu, Met, Asn, Pro, Ser, Thr, Val, or Trp
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGPHCXKTXPXVVXGENNT

SEQ ID NO: 25691 - protein, 20 aa, Artificial Sequence
  Description of Artificial Sequence: Synthetic peptide
  Seed: DGPHCVKTCPAVVMGENNTL (EGFR G598V)
  Core: CVKTCPAVV
  misc_feature (5)..(5): Xaa can be Ala, Cys, Asp, Glu, Phe, His, Ile, Leu, Met, Asn, Pro, Gln, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DGPHXVKXCXAVXMGENNTL

SEQ ID NO: 25692 - protein, 20 aa, Artificial Sequence
  Description of Artificial Sequence: Synthetic peptide
  Seed: DGPHCVKTCPAVVMGENNTL (EGFR G598V)
  Core: VKTCPAVVM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGPHCXKTXPXVVXGENNTL

SEQ ID NO: 25693 - protein, 20 aa, Artificial Sequence
  Description of Artificial Sequence: Synthetic peptide
  Seed: DGPHCVKTCPAVVMGENNTL (EGFR G598V)
  Core: TCPAVVMGE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Ser, Thr, Val, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DGPHCVKXCPXVXMGXNNTL

SEQ ID NO: 25694 - protein, 21 aa, Artificial Sequence
  Description of Artificial Sequence: Synthetic peptide
  Seed: DGPHCVKTCPAVVMGENNTLV (EGFR G598V)
  Core: VKTCPAVVM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGPHCXKTXPXVVXGENNTLV

SEQ ID NO: 25695 - protein, 22 aa, Artificial Sequence
  Description of Artificial Sequence: Synthetic peptide
  Seed: DGPHCVKTCPAVVMGENNTLVW (EGFR G598V)
  Core: VKTCPAVVM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGPHCXKTXPXVVXGENNTLVW

SEQ ID NO: 25696 - protein, 23 aa, Artificial Sequence
  Description of Artificial Sequence: Synthetic peptide
  Seed: DGPHCVKTCPAVVMGENNTLVWK (EGFR G598V)
  Core: VKTCPAVVM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGPHCXKTXPXVVXGENNTLVWK

SEQ ID NO: 25697 - protein, 24 aa, Artificial Sequence
  Description of Artificial Sequence: Synthetic peptide
  Seed: DGPHCVKTCPAVVMGENNTLVWKY (EGFR G598V)
  Core: VKTCPAVVM
  misc_feature (6)..(6): Xaa can be Ala, Cys, Glu, Phe, His, Ile, Lys, Leu, Met, Asn, Pro, Gln, Arg, Ser, Thr, Val, Trp, or Ty r
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGPHCXKTXPXVVXGENNTLVWKY

SEQ ID NO: 25698 - protein, 25 aa, Artificial Sequence
  Description of Artificial Sequence: Synthetic peptide
  Seed: DGPHCVKTCPAVVMGENNTLVWKYA (EGFR G598V)
  Core: VKTCPAVVM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGPHCXKTXPXVVXGENNTLVWKYA

SEQ ID NO: 25699 - protein, 24 aa, Artificial Sequence
  Description of Artificial Sequence: Synthetic peptide
  Seed: DNCIQCAHYIDGPHCVKTCPAVVM (EGFR G598V)
  Core: CVKTCPAVV
  misc_feature (15)..(15): Xaa can be Ala, Cys, Phe, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DNCIQCAHYIDGPHXVKXCXAVXM

SEQ ID NO: 25700 - protein, 25 aa, Artificial Sequence
  Description of Artificial Sequence: Synthetic peptide
  Seed: DNCIQCAHYIDGPHCVKTCPAVVMG (EGFR G598V)
  Core: CVKTCPAVV
  misc_feature (15)..(15): Xaa can be Ala, Cys, Glu, Phe, His, Ile, Lys, Leu, Met, Asn, Pro, Gln, Arg, Ser, Thr, Val, Trp, or Ty r
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DNCIQCAHYIDGPHXVKXCXAVXMG

SEQ ID NO: 25701 - protein, 25 aa, Artificial Sequence
  Description of Artificial Sequence: Synthetic peptide
  Seed: DNCIQCAHYIDGPHCVKTCPAVVMG (EGFR G598V)
  Core: VKTCPAVVM
  misc_feature (16)..(16): Xaa can be Ala, Cys, Phe, His, Ile, Lys, Leu, Met, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
DNCIQCAHYIDGPHCXKTXPXVVXG

SEQ ID NO: 25702 - protein, 15 aa, Artificial Sequence
  Description of Artificial Sequence: Synthetic peptide
  Seed: GPHCVKTCPAVVMGE (EGFR G598V)
  Core: CVKTCPAVV
  misc_feature (4)..(4): Xaa can be Ala, Cys, Asp, Glu, Phe, Gly, His, Ile, Lys, Leu, Met, Asn, Pro, Gln, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPHXVKXCXAVXMGE

SEQ ID NO: 25703 - protein, 15 aa, Artificial Sequence
  Description of Artificial Sequence: Synthetic peptide
  Seed: GPHCVKTCPAVVMGE (EGFR G598V)
  Core: VKTCPAVVM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPHCXKTXPXVVXGE

SEQ ID NO: 25704 - protein, 16 aa, Artificial Sequence
  Description of Artificial Sequence: Synthetic peptide
  Seed: GPHCVKTCPAVVMGEN (EGFR G598V)
  Core: VKTCPAVVM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Glu, Phe, Gly, His, Ile, Leu, Met, Asn, Pro, Gln, Arg, Ser, Thr, Val, Trp, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPHCXKTXPXVVXGEN

SEQ ID NO: 25705 - protein, 17 aa, Artificial Sequence
  Description of Artificial Sequence: Synthetic peptide
  Seed: GPHCVKTCPAVVMGENN (EGFR G598V)
  Core: VKTCPAVVM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPHCXKTXPXVVXGENN

SEQ ID NO: 25706 - protein, 19 aa, Artificial Sequence
  Description of Artificial Sequence: Synthetic peptide
  Seed: GPHCVKTCPAVVMGENNTL (EGFR G598V)
  Core: VKTCPAVVM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (10)..(10): Xaa can be Ala, Cys, Glu, Phe, Gly, Ile, Leu, Met, Asn, Pro, Ser, Thr, or Val
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPHCXKTXPXVVXGENNTL

SEQ ID NO: 25707 - protein, 20 aa, Artificial Sequence
  Description of Artificial Sequence: Synthetic peptide
  Seed: GPHCVKTCPAVVMGENNTLV (EGFR G598V)
  Core: VKTCPAVVM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPHCXKTXPXVVXGENNTLV

SEQ ID NO: 25708 - protein, 20 aa, Artificial Sequence
  Description of Artificial Sequence: Synthetic peptide
  Seed: GPHCVKTCPAVVMGENNTLV (EGFR G598V)
  Core: TCPAVVMGE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPHCVKXCPXVXMGXNNTLV

SEQ ID NO: 25709 - protein, 21 aa, Artificial Sequence
  Description of Artificial Sequence: Synthetic peptide
  Seed: GPHCVKTCPAVVMGENNTLVW (EGFR G598V)
  Core: VKTCPAVVM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPHCXKTXPXVVXGENNTLVW

SEQ ID NO: 25710 - protein, 22 aa, Artificial Sequence
  Description of Artificial Sequence: Synthetic peptide
  Seed: GPHCVKTCPAVVMGENNTLVWK (EGFR G598V)
  Core: VKTCPAVVM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPHCXKTXPXVVXGENNTLVWK

SEQ ID NO: 25711 - protein, 23 aa, Artificial Sequence
  Description of Artificial Sequence: Synthetic peptide
  Seed: GPHCVKTCPAVVMGENNTLVWKY (EGFR G598V)
  Core: VKTCPAVVM
  misc_feature (5)..(5): Xaa can be Ala, Glu, Phe, His, Ile, Leu, Met, Pro, Gln, Ser, Thr, Val, Trp, or Tyr
  misc_feature (8)..(8): Xaa can be Ala, Cys, Phe, Gly, Ile, Leu, Met, Asn, Gln, Ser, Thr, Val, Trp, or Tyr
  misc_feature (10)..(10): Xaa can be Ala, Cys, Gly, Ile, Leu, Met, Pro, Ser, Thr, or Val
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPHCXKTXPXVVXGENNTLVWKY

SEQ ID NO: 25712 - protein, 24 aa, Artificial Sequence
  Description of Artificial Sequence: Synthetic peptide
  Seed: GPHCVKTCPAVVMGENNTLVWKYA (EGFR G598V)
  Core: VKTCPAVVM
  misc_feature (5)..(5): Xaa can be Ala, Glu, Phe, His, Ile, Leu, Met, Pro, Gln, Ser, Thr, Val, Trp, or Tyr
  misc_feature (8)..(8): Xaa can be Ala, Cys, Phe, Gly, Ile, Leu, Met, Asn, Gln, Ser, Thr, Val, Trp, or Tyr
  misc_feature (10)..(10): Xaa can be Ala, Cys, Gly, Ile, Leu, Met, Pro, Ser, Thr, or Val
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPHCXKTXPXVVXGENNTLVWKYA

SEQ ID NO: 25713 - protein, 25 aa, Artificial Sequence
  Description of Artificial Sequence: Synthetic peptide
  Seed: GPHCVKTCPAVVMGENNTLVWKYAD (EGFR G598V)
  Core: VKTCPAVVM
  misc_feature (5)..(5): Xaa can be Ala, Glu, Phe, His, Ile, Leu, Met, Pro, Gln, Ser, Thr, Val, Trp, or Tyr
  misc_feature (8)..(8): Xaa can be Ala, Cys, Glu, Phe, Gly, Ile, Leu, Met, Asn, Gln, Ser, Thr, Val, Trp, or Tyr
  misc_feature (10)..(10): Xaa can be Ala, Cys, Gly, Ile, Leu, Met, Pro, Ser, Thr, or Val
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPHCXKTXPXVVXGENNTLVWKYAD

SEQ ID NO: 25714 - protein, 14 aa, Artificial Sequence
  Description of Artificial Sequence: Synthetic peptide
  Seed: HCVKTCPAVVMGEN (EGFR G598V)
  Core: VKTCPAVVM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Leu, Met, Asn, Gln, Ser, Thr, Val, Trp, or Tyr
  misc_feature (8)..(8): Xaa can be Ala, Cys, Phe, Gly, Ile, Leu, Met, Asn, Pro, Ser, Thr, Val, or Trp
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HCXKTXPXVVXGEN

SEQ ID NO: 25715 - protein, 15 aa, Artificial Sequence
  Description of Artificial Sequence: Synthetic peptide
  Seed: HCVKTCPAVVMGENN (EGFR G598V)
  Core: VKTCPAVVM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HCXKTXPXVVXGENN

SEQ ID NO: 25716 - protein, 15 aa, Artificial Sequence
  Description of Artificial Sequence: Synthetic peptide
  Seed: HCVKTCPAVVMGENN (EGFR G598V)
  Core: TCPAVVMGE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Phe, Gly, His, Ile, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HCVKXCPXVXMGXNN

SEQ ID NO: 25717 - protein, 16 aa, Artificial Sequence
  Description of Artificial Sequence: Synthetic peptide
  Seed: HCVKTCPAVVMGENNT (EGFR G598V)
  Core: VKTCPAVVM
  misc_feature (3)..(3): Xaa can be Ala, Cys, Asp, Glu, Phe, Gly, His, Ile, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Leu, Met, Asn, Gln, Ser, Thr, Val, or Trp
  misc_feature (8)..(8): Xaa can be Ala, Cys, Glu, Phe, Gly, Ile, Leu, Met, Asn, Pro, Gln, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HCXKTXPXVVXGENNT

SEQ ID NO: 25718 - protein, 17 aa, Artificial Sequence
  Description of Artificial Sequence: Synthetic peptide
  Seed: HCVKTCPAVVMGENNTL (EGFR G598V)
  Core: VKTCPAVVM
  misc_feature (3)..(3): Xaa can be Ala, Cys, Asp, Glu, Phe, Gly, His, Ile, Leu, Met, Asn, Pro, Gln, Ser, Thr, Val, Trp, or Ty r
  misc_feature (6)..(6): Xaa can be Ala, Cys, Asp, Phe, Gly, Ile, Leu, Met, Asn, Gln, Ser, Thr, Val, or Trp
  misc_feature (8)..(8): Xaa can be Ala, Cys, Phe, Gly, Ile, Leu, Met, Asn, Pro, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HCXKTXPXVVXGENNTL

SEQ ID NO: 25719 - protein, 19 aa, Artificial Sequence
  Description of Artificial Sequence: Synthetic peptide
  Seed: HCVKTCPAVVMGENNTLVW (EGFR G598V)
  Core: VKTCPAVVM
  misc_feature (3)..(3): Xaa can be Ala, Cys, Asp, Glu, Phe, Gly, His, Ile, Lys, Leu, Met, Pro, Gln, Arg, Thr, Val, Trp, or Ty r
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HCXKTXPXVVXGENNTLVW

SEQ ID NO: 25720 - protein, 17 aa, Artificial Sequence
  Description of Artificial Sequence: Synthetic peptide
  Seed: HYIDGPHCVKTCPAVVM (EGFR G598V)
  Core: CVKTCPAVV
  misc_feature (8)..(8): Xaa can be Ala, Cys, Glu, Phe, His, Ile, Lys, Leu, Met, Asn, Pro, Gln, Arg, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HYIDGPHXVKXCXAVXM

SEQ ID NO: 25721 - protein, 20 aa, Artificial Sequence
  Description of Artificial Sequence: Synthetic peptide
  Seed: HYIDGPHCVKTCPAVVMGEN (EGFR G598V)
  Core: CVKTCPAVV
  misc_feature (8)..(8): Xaa can be Ala, Cys, Glu, Phe, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HYIDGPHXVKXCXAVXMGEN

SEQ ID NO: 25722 - protein, 20 aa, Artificial Sequence
  Description of Artificial Sequence: Synthetic peptide
  Seed: HYIDGPHCVKTCPAVVMGEN (EGFR G598V)
  Core: VKTCPAVVM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HYIDGPHCXKTXPXVVXGEN

SEQ ID NO: 25723 - protein, 21 aa, Artificial Sequence
  Description of Artificial Sequence: Synthetic peptide
  Seed: HYIDGPHCVKTCPAVVMGENN (EGFR G598V)
  Core: CVKTCPAVV
  misc_feature (8)..(8): Xaa can be Ala, Cys, Phe, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HYIDGPHXVKXCXAVXMGENN

SEQ ID NO: 25724 - protein, 21 aa, Artificial Sequence
  Description of Artificial Sequence: Synthetic peptide
  Seed: HYIDGPHCVKTCPAVVMGENN (EGFR G598V)
  Core: VKTCPAVVM
  misc_feature (9)..(9): Xaa can be Ala, Cys, Phe, His, Ile, Lys, Leu, Met, Asn, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HYIDGPHCXKTXPXVVXGENN

SEQ ID NO: 25725 - protein, 22 aa, Artificial Sequence
  Description of Artificial Sequence: Synthetic peptide
  Seed: HYIDGPHCVKTCPAVVMGENNT (EGFR G598V)
  Core: CVKTCPAVV
  misc_feature (8)..(8): Xaa can be Ala, Cys, Glu, Phe, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HYIDGPHXVKXCXAVXMGENNT

SEQ ID NO: 25726 - protein, 22 aa, Artificial Sequence
  Description of Artificial Sequence: Synthetic peptide
  Seed: HYIDGPHCVKTCPAVVMGENNT (EGFR G598V)
  Core: VKTCPAVVM
  misc_feature (9)..(9): Xaa can be Ala, Cys, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HYIDGPHCXKTXPXVVXGENNT

SEQ ID NO: 25727 - protein, 23 aa, Artificial Sequence
  Description of Artificial Sequence: Synthetic peptide
  Seed: HYIDGPHCVKTCPAVVMGENNTL (EGFR G598V)
  Core: CVKTCPAVV
  misc_feature (8)..(8): Xaa can be Ala, Cys, Glu, Phe, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HYIDGPHXVKXCXAVXMGENNTL

SEQ ID NO: 25728 - protein, 23 aa, Artificial Sequence
  Description of Artificial Sequence: Synthetic peptide
  Seed: HYIDGPHCVKTCPAVVMGENNTL (EGFR G598V)
  Core: VKTCPAVVM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HYIDGPHCXKTXPXVVXGENNTL

SEQ ID NO: 25729 - protein, 24 aa, Artificial Sequence
  Description of Artificial Sequence: Synthetic peptide
  Seed: HYIDGPHCVKTCPAVVMGENNTLV (EGFR G598V)
  Core: CVKTCPAVV
  misc_feature (8)..(8): Xaa can be Ala, Cys, Glu, Phe, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HYIDGPHXVKXCXAVXMGENNTLV

SEQ ID NO: 25730 - protein, 24 aa, Artificial Sequence
  Description of Artificial Sequence: Synthetic peptide
  Seed: HYIDGPHCVKTCPAVVMGENNTLV (EGFR G598V)
  Core: VKTCPAVVM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HYIDGPHCXKTXPXVVXGENNTLV

SEQ ID NO: 25731 - protein, 25 aa, Artificial Sequence
  Description of Artificial Sequence: Synthetic peptide
  Seed: HYIDGPHCVKTCPAVVMGENNTLVW (EGFR G598V)
  Core: CVKTCPAVV
  misc_feature (8)..(8): Xaa can be Ala, Cys, Asp, Glu, Phe, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HYIDGPHXVKXCXAVXMGENNTLVW

SEQ ID NO: 25732 - protein, 25 aa, Artificial Sequence
  Description of Artificial Sequence: Synthetic peptide
  Seed: HYIDGPHCVKTCPAVVMGENNTLVW (EGFR G598V)
  Core: VKTCPAVVM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HYIDGPHCXKTXPXVVXGENNTLVW

SEQ ID NO: 25733 - protein, 15 aa, Artificial Sequence
  Description of Artificial Sequence: Synthetic peptide
  Seed: IDGPHCVKTCPAVVM (EGFR G598V)
  Core: CVKTCPAVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IDGPHXVKXCXAVXM

SEQ ID NO: 25734 - protein, 15 aa, Artificial Sequence
  Description of Artificial Sequence: Synthetic peptide
  Seed: IDGPHCVKTCPAVVM (EGFR G598V)
  Core: VKTCPAVVM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IDGPHCXKTXPXVVX

SEQ ID NO: 25735 - protein, 16 aa, Artificial Sequence
  Description of Artificial Sequence: Synthetic peptide
  Seed: IDGPHCVKTCPAVVMG (EGFR G598V)
  Core: CVKTCPAVV
  misc_feature (6)..(6): Xaa can be Ala, Cys, Glu, Phe, His, Ile, Lys, Leu, Met, Asn, Pro, Gln, Arg, Ser, Thr, Val, Trp, or Ty r
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IDGPHXVKXCXAVXMG

SEQ ID NO: 25736 - protein, 17 aa, Artificial Sequence
  Description of Artificial Sequence: Synthetic peptide
  Seed: IDGPHCVKTCPAVVMGE (EGFR G598V)
  Core: CVKTCPAVV
  misc_feature (6)..(6): Xaa can be Ala, Cys, Glu, Phe, His, Ile, Lys, Leu, Met, Asn, Pro, Gln, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IDGPHXVKXCXAVXMGE

SEQ ID NO: 25737 - protein, 17 aa, Artificial Sequence
  Description of Artificial Sequence: Synthetic peptide
  Seed: IDGPHCVKTCPAVVMGE (EGFR G598V)
  Core: VKTCPAVVM
  misc_feature (7)..(7): Xaa can be Ala, Cys, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IDGPHCXKTXPXVVXGE

SEQ ID NO: 25738 - protein, 20 aa, Artificial Sequence
  Description of Artificial Sequence: Synthetic peptide
  Seed: IDGPHCVKTCPAVVMGENNT (EGFR G598V)
  Core: CVKTCPAVV
  misc_feature (6)..(6): Xaa can be Ala, Cys, Glu, Phe, His, Ile, Leu, Met, Asn, Pro, Gln, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IDGPHXVKXCXAVXMGENNT

SEQ ID NO: 25739 - protein, 20 aa, Artificial Sequence
  Description of Artificial Sequence: Synthetic peptide
  Seed: IDGPHCVKTCPAVVMGENNT (EGFR G598V)
  Core: VKTCPAVVM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IDGPHCXKTXPXVVXGENNT

SEQ ID NO: 25740 - protein, 21 aa, Artificial Sequence
  Description of Artificial Sequence: Synthetic peptide
  Seed: IDGPHCVKTCPAVVMGENNTL (EGFR G598V)
  Core: VKTCPAVVM
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IDGPHCXKTXPXVVXGENNTL

SEQ ID NO: 25741 - protein, 22 aa, Artificial Sequence
  Description of Artificial Sequence: Synthetic peptide
  Seed: IDGPHCVKTCPAVVMGENNTLV (EGFR G598V)
  Core: CVKTCPAVV
  misc_feature (6)..(6): Xaa can be Ala, Cys, Glu, Phe, His, Ile, Leu, Met, Asn, Pro, Gln, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IDGPHXVKXCXAVXMGENNTLV

SEQ ID NO: 25742 - protein, 22 aa, Artificial Sequence
  Description of Artificial Sequence: Synthetic peptide
  Seed: IDGPHCVKTCPAVVMGENNTLV (EGFR G598V)
  Core: VKTCPAVVM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IDGPHCXKTXPXVVXGENNTLV

SEQ ID NO: 25743 - protein, 23 aa, Artificial Sequence
  Description of Artificial Sequence: Synthetic peptide
  Seed: IDGPHCVKTCPAVVMGENNTLVW (EGFR G598V)
  Core: CVKTCPAVV
  misc_feature (6)..(6): Xaa can be Ala, Cys, Glu, Phe, His, Ile, Leu, Met, Asn, Pro, Gln, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IDGPHXVKXCXAVXMGENNTLVW

SEQ ID NO: 25744 - protein, 23 aa, Artificial Sequence
  Description of Artificial Sequence: Synthetic peptide
  Seed: IDGPHCVKTCPAVVMGENNTLVW (EGFR G598V)
  Core: VKTCPAVVM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IDGPHCXKTXPXVVXGENNTLVW

SEQ ID NO: 25745 - protein, 24 aa, Artificial Sequence
  Description of Artificial Sequence: Synthetic peptide
  Seed: IDGPHCVKTCPAVVMGENNTLVWK (EGFR G598V)
  Core: CVKTCPAVV
  misc_feature (6)..(6): Xaa can be Ala, Cys, Asp, Glu, Phe, His, Ile, Leu, Met, Asn, Pro, Gln, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IDGPHXVKXCXAVXMGENNTLVWK

SEQ ID NO: 25746 - protein, 24 aa, Artificial Sequence
  Description of Artificial Sequence: Synthetic peptide
  Seed: IDGPHCVKTCPAVVMGENNTLVWK (EGFR G598V)
  Core: VKTCPAVVM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IDGPHCXKTXPXVVXGENNTLVWK

SEQ ID NO: 25747 - protein, 25 aa, Artificial Sequence
  Description of Artificial Sequence: Synthetic peptide
  Seed: IDGPHCVKTCPAVVMGENNTLVWKY (EGFR G598V)
  Core: VKTCPAVVM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IDGPHCXKTXPXVVXGENNTLVWKY

SEQ ID NO: 25748 - protein, 22 aa, Artificial Sequence
  Description of Artificial Sequence: Synthetic peptide
  Seed: IQCAHYIDGPHCVKTCPAVVMG (EGFR G598V)
  Core: CVKTCPAVV
  misc_feature (12)..(12): Xaa can be Ala, Cys, Glu, Phe, His, Ile, Lys, Leu, Met, Asn, Pro, Gln, Arg, Ser, Thr, Val, Trp, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IQCAHYIDGPHXVKXCXAVXMG

SEQ ID NO: 25749 - protein, 23 aa, Artificial Sequence
  Description of Artificial Sequence: Synthetic peptide
  Seed: IQCAHYIDGPHCVKTCPAVVMGE (EGFR G598V)
  Core: CVKTCPAVV
  misc_feature (12)..(12): Xaa can be Ala, Cys, Glu, Phe, His, Ile, Lys, Leu, Met, Asn, Pro, Gln, Arg, Ser, Thr, Val, Trp, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IQCAHYIDGPHXVKXCXAVXMGE

SEQ ID NO: 25750 - protein, 23 aa, Artificial Sequence
  Description of Artificial Sequence: Synthetic peptide
  Seed: IQCAHYIDGPHCVKTCPAVVMGE (EGFR G598V)
  Core: VKTCPAVVM
  misc_feature (13)..(13): Xaa can be Ala, Cys, Phe, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IQCAHYIDGPHCXKTXPXVVXGE

SEQ ID NO: 25751 - protein, 24 aa, Artificial Sequence
  Description of Artificial Sequence: Synthetic peptide
  Seed: IQCAHYIDGPHCVKTCPAVVMGEN (EGFR G598V)
  Core: CVKTCPAVV
  misc_feature (12)..(12): Xaa can be Ala, Cys, Glu, Phe, His, Ile, Leu, Met, Asn, Pro, Gln, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IQCAHYIDGPHXVKXCXAVXMGEN

SEQ ID NO: 25752 - protein, 24 aa, Artificial Sequence
  Description of Artificial Sequence: Synthetic peptide
  Seed: IQCAHYIDGPHCVKTCPAVVMGEN (EGFR G598V)
  Core: VKTCPAVVM
  misc_feature (13)..(13): Xaa can be Ala, Cys, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IQCAHYIDGPHCXKTXPXVVXGEN

SEQ ID NO: 25753 - protein, 25 aa, Artificial Sequence
  Description of Artificial Sequence: Synthetic peptide
  Seed: IQCAHYIDGPHCVKTCPAVVMGENN (EGFR G598V)
  Core: CVKTCPAVV
  misc_feature (12)..(12): Xaa can be Ala, Cys, Glu, Phe, His, Ile, Leu, Met, Asn, Pro, Gln, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IQCAHYIDGPHXVKXCXAVXMGENN

SEQ ID NO: 25754 - protein, 25 aa, Artificial Sequence
  Description of Artificial Sequence: Synthetic peptide
  Seed: IQCAHYIDGPHCVKTCPAVVMGENN (EGFR G598V)
  Core: VKTCPAVVM
  misc_feature (13)..(13): Xaa can be Ala, Cys, Glu, Phe, Gly, His, Ile, Lys, Leu, Met, Asn, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IQCAHYIDGPHCXKTXPXVVXGENN

SEQ ID NO: 25755 - protein, 24 aa, Artificial Sequence
  Description of Artificial Sequence: Synthetic peptide
  Seed: NCIQCAHYIDGPHCVKTCPAVVMG (EGFR G598V)
  Core: CVKTCPAVV
  misc_feature (14)..(14): Xaa can be Ala, Cys, Glu, Phe, His, Ile, Lys, Leu, Met, Asn, Pro, Gln, Arg, Ser, Thr, Val, Trp, or Ty r
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
NCIQCAHYIDGPHXVKXCXAVXMG

SEQ ID NO: 25756 - protein, 24 aa, Artificial Sequence
  Description of Artificial Sequence: Synthetic peptide
  Seed: NCIQCAHYIDGPHCVKTCPAVVMG (EGFR G598V)
  Core: VKTCPAVVM
  misc_feature (15)..(15): Xaa can be Ala, Cys, Phe, His, Ile, Lys, Leu, Met, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
NCIQCAHYIDGPHCXKTXPXVVXG

SEQ ID NO: 25757 - protein, 25 aa, Artificial Sequence
  Description of Artificial Sequence: Synthetic peptide
  Seed: NCIQCAHYIDGPHCVKTCPAVVMGE (EGFR G598V)
  Core: CVKTCPAVV
  misc_feature (14)..(14): Xaa can be Ala, Cys, Glu, Phe, His, Ile, Lys, Leu, Met, Asn, Pro, Gln, Arg, Ser, Thr, Val, Trp, or Ty r
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
NCIQCAHYIDGPHXVKXCXAVXMGE

SEQ ID NO: 25758 - protein, 25 aa, Artificial Sequence
  Description of Artificial Sequence: Synthetic peptide
  Seed: NCIQCAHYIDGPHCVKTCPAVVMGE (EGFR G598V)
  Core: VKTCPAVVM
  misc_feature (15)..(15): Xaa can be Ala, Cys, Phe, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
NCIQCAHYIDGPHCXKTXPXVVXGE

SEQ ID NO: 25759 - protein, 25 aa, Artificial Sequence
  Description of Artificial Sequence: Synthetic peptide
  Seed: PDNCIQCAHYIDGPHCVKTCPAVVM (EGFR G598V)
  Core: CVKTCPAVV
  misc_feature (16)..(16): Xaa can be Ala, Cys, Phe, His, Ile, Lys, Leu, Met, Asn, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
PDNCIQCAHYIDGPHXVKXCXAVXM

SEQ ID NO: 25760 - protein, 14 aa, Artificial Sequence
  Description of Artificial Sequence: Synthetic peptide
  Seed: PHCVKTCPAVVMGE (EGFR G598V)
  Core: VKTCPAVVM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Phe, Gly, Ile, Leu, Met, Asn, Pro, Ser, Thr, Val, or Trp
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PHCXKTXPXVVXGE

SEQ ID NO: 25761 - protein, 15 aa, Artificial Sequence
  Description of Artificial Sequence: Synthetic peptide
  Seed: PHCVKTCPAVVMGEN (EGFR G598V)
  Core: VKTCPAVVM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PHCXKTXPXVVXGEN

SEQ ID NO: 25762 - protein, 16 aa, Artificial Sequence
  Description of Artificial Sequence: Synthetic peptide
  Seed: PHCVKTCPAVVMGENN (EGFR G598V)
  Core: VKTCPAVVM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Ser, Thr, Val, Trp, or Tyr
  misc_feature (9)..(9): Xaa can be Ala, Cys, Glu, Phe, Gly, His, Ile, Leu, Met, Asn, Pro, Gln, Arg, Ser, Thr, Val, Trp, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PHCXKTXPXVVXGENN

SEQ ID NO: 25763 - protein, 17 aa, Artificial Sequence
  Description of Artificial Sequence: Synthetic peptide
  Seed: PHCVKTCPAVVMGENNT (EGFR G598V)
  Core: VKTCPAVVM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Leu, Met, Asn, Gln, Ser, Thr, Val, Trp, or Tyr
  misc_feature (9)..(9): Xaa can be Ala, Cys, Phe, Gly, Ile, Leu, Met, Asn, Pro, Ser, Thr, Val, or Trp
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PHCXKTXPXVVXGENNT

SEQ ID NO: 25764 - protein, 17 aa, Artificial Sequence
  Description of Artificial Sequence: Synthetic peptide
  Seed: PHCVKTCPAVVMGENNT (EGFR G598V)
  Core: TCPAVVMGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Phe, Gly, His, Ile, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PHCVKXCPXVXMGXNNT

SEQ ID NO: 25765 - protein, 19 aa, Artificial Sequence
  Description of Artificial Sequence: Synthetic peptide
  Seed: PHCVKTCPAVVMGENNTLV (EGFR G598V)
  Core: VKTCPAVVM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PHCXKTXPXVVXGENNTLV

SEQ ID NO: 25766 - protein, 20 aa, Artificial Sequence
  Description of Artificial Sequence: Synthetic peptide
  Seed: PHCVKTCPAVVMGENNTLVW (EGFR G598V)
  Core: VKTCPAVVM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PHCXKTXPXVVXGENNTLVW

SEQ ID NO: 25767 - protein, 20 aa, Artificial Sequence
  Description of Artificial Sequence: Synthetic peptide
  Seed: PHCVKTCPAVVMGENNTLVW (EGFR G598V)
  Core: TCPAVVMGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Glu, Phe, Gly, His, Ile, Lys, Leu, Met, Asn, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Ser, Thr, Val, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PHCVKXCPXVXMGXNNTLVW

SEQ ID NO: 25768 - protein, 20 aa, Artificial Sequence
  Description of Artificial Sequence: Synthetic peptide
  Seed: QCAHYIDGPHCVKTCPAVVM (EGFR G598V)
  Core: CVKTCPAVV
  misc_feature (11)..(11): Xaa can be Ala, Cys, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QCAHYIDGPHXVKXCXAVXM

SEQ ID NO: 25769 - protein, 21 aa, Artificial Sequence
  Description of Artificial Sequence: Synthetic peptide
  Seed: QCAHYIDGPHCVKTCPAVVMG (EGFR G598V)
  Core: CVKTCPAVV
  misc_feature (11)..(11): Xaa can be Ala, Cys, Phe, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QCAHYIDGPHXVKXCXAVXMG

SEQ ID NO: 25770 - protein, 22 aa, Artificial Sequence
  Description of Artificial Sequence: Synthetic peptide
  Seed: QCAHYIDGPHCVKTCPAVVMGE (EGFR G598V)
  Core: CVKTCPAVV
  misc_feature (11)..(11): Xaa can be Ala, Cys, Glu, Phe, His, Ile, Lys, Leu, Met, Asn, Pro, Gln, Arg, Ser, Thr, Val, Trp, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QCAHYIDGPHXVKXCXAVXMGE

SEQ ID NO: 25771 - protein, 22 aa, Artificial Sequence
  Description of Artificial Sequence: Synthetic peptide
  Seed: QCAHYIDGPHCVKTCPAVVMGE (EGFR G598V)
  Core: VKTCPAVVM
  misc_feature (12)..(12): Xaa can be Ala, Cys, Phe, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QCAHYIDGPHCXKTXPXVVXGE

SEQ ID NO: 25772 - protein, 23 aa, Artificial Sequence
  Description of Artificial Sequence: Synthetic peptide
  Seed: QCAHYIDGPHCVKTCPAVVMGEN (EGFR G598V)
  Core: CVKTCPAVV
  misc_feature (11)..(11): Xaa can be Ala, Cys, Glu, Phe, His, Ile, Leu, Met, Asn, Pro, Gln, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QCAHYIDGPHXVKXCXAVXMGEN

SEQ ID NO: 25773 - protein, 23 aa, Artificial Sequence
  Description of Artificial Sequence: Synthetic peptide
  Seed: QCAHYIDGPHCVKTCPAVVMGEN (EGFR G598V)
  Core: VKTCPAVVM
  misc_feature (12)..(12): Xaa can be Ala, Cys, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QCAHYIDGPHCXKTXPXVVXGEN

SEQ ID NO: 25774 - protein, 24 aa, Artificial Sequence
  Description of Artificial Sequence: Synthetic peptide
  Seed: QCAHYIDGPHCVKTCPAVVMGENN (EGFR G598V)
  Core: CVKTCPAVV
  misc_feature (11)..(11): Xaa can be Ala, Cys, Glu, Phe, His, Ile, Leu, Met, Asn, Pro, Gln, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QCAHYIDGPHXVKXCXAVXMGENN

SEQ ID NO: 25775 - protein, 24 aa, Artificial Sequence
  Description of Artificial Sequence: Synthetic peptide
  Seed: QCAHYIDGPHCVKTCPAVVMGENN (EGFR G598V)
  Core: VKTCPAVVM
  misc_feature (12)..(12): Xaa can be Ala, Cys, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QCAHYIDGPHCXKTXPXVVXGENN

SEQ ID NO: 25776 - protein, 25 aa, Artificial Sequence
  Description of Artificial Sequence: Synthetic peptide
  Seed: QCAHYIDGPHCVKTCPAVVMGENNT (EGFR G598V)
  Core: CVKTCPAVV
  misc_feature (11)..(11): Xaa can be Ala, Cys, Glu, Phe, His, Ile, Leu, Met, Asn, Pro, Gln, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QCAHYIDGPHXVKXCXAVXMGENNT

SEQ ID NO: 25777 - protein, 25 aa, Artificial Sequence
  Description of Artificial Sequence: Synthetic peptide
  Seed: QCAHYIDGPHCVKTCPAVVMGENNT (EGFR G598V)
  Core: VKTCPAVVM
  misc_feature (12)..(12): Xaa can be Ala, Cys, Glu, Phe, Gly, His, Ile, Lys, Leu, Met, Asn, Gln, Arg, Ser, Thr, Val, Trp, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QCAHYIDGPHCXKTXPXVVXGENNT

SEQ ID NO: 25778 - protein, 15 aa, Artificial Sequence
  Description of Artificial Sequence: Synthetic peptide
  Seed: VKTCPAVVMGENNTL (EGFR G598V)
  Core: TCPAVVMGE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VKXCPXVXMGXNNTL

SEQ ID NO: 25779 - protein, 15 aa, Artificial Sequence
  Description of Artificial Sequence: Synthetic peptide
  Seed: VKTCPAVVMGENNTL (EGFR G598V)
  Core: PAVVMGENN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKTCXAVXMXENXTL

SEQ ID NO: 25780 - protein, 15 aa, Artificial Sequence
  Description of Artificial Sequence: Synthetic peptide
  Seed: YIDGPHCVKTCPAVV (EGFR G598V)
  Core: CVKTCPAVV
  misc_feature (7)..(7): Xaa can be Ala, Cys, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YIDGPHXVKXCXAVX

SEQ ID NO: 25781 - protein, 16 aa, Artificial Sequence
  Description of Artificial Sequence: Synthetic peptide
  Seed: YIDGPHCVKTCPAVVM (EGFR G598V)
  Core: CVKTCPAVV
  misc_feature (7)..(7): Xaa can be Ala, Cys, Glu, Phe, His, Ile, Lys, Leu, Met, Asn, Pro, Gln, Arg, Ser, Thr, Val, Trp, or Ty r
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YIDGPHXVKXCXAVXM

SEQ ID NO: 25782 - protein, 17 aa, Artificial Sequence
  Description of Artificial Sequence: Synthetic peptide
  Seed: YIDGPHCVKTCPAVVMG (EGFR G598V)
  Core: CVKTCPAVV
  misc_feature (7)..(7): Xaa can be Ala, Cys, Glu, Phe, His, Ile, Lys, Leu, Met, Asn, Pro, Gln, Arg, Ser, Thr, Val, Trp, or Ty r
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YIDGPHXVKXCXAVXMG

SEQ ID NO: 25783 - protein, 17 aa, Artificial Sequence
  Description of Artificial Sequence: Synthetic peptide
  Seed: YIDGPHCVKTCPAVVMG (EGFR G598V)
  Core: VKTCPAVVM
  misc_feature (8)..(8): Xaa can be Ala, Cys, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YIDGPHCXKTXPXVVXG

SEQ ID NO: 25784 - protein, 20 aa, Artificial Sequence
  Description of Artificial Sequence: Synthetic peptide
  Seed: YIDGPHCVKTCPAVVMGENN (EGFR G598V)
  Core: CVKTCPAVV
  misc_feature (7)..(7): Xaa can be Ala, Cys, Glu, Phe, His, Ile, Leu, Met, Asn, Pro, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YIDGPHXVKXCXAVXMGENN

SEQ ID NO: 25785 - protein, 20 aa, Artificial Sequence
  Description of Artificial Sequence: Synthetic peptide
  Seed: YIDGPHCVKTCPAVVMGENN (EGFR G598V)
  Core: VKTCPAVVM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YIDGPHCXKTXPXVVXGENN

SEQ ID NO: 25786 - protein, 21 aa, Artificial Sequence
  Description of Artificial Sequence: Synthetic peptide
  Seed: YIDGPHCVKTCPAVVMGENNT (EGFR G598V)
  Core: VKTCPAVVM
  misc_feature (8)..(8): Xaa can be Ala, Cys, Phe, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YIDGPHCXKTXPXVVXGENNT

SEQ ID NO: 25787 - protein, 22 aa, Artificial Sequence
  Description of Artificial Sequence: Synthetic peptide
  Seed: YIDGPHCVKTCPAVVMGENNTL (EGFR G598V)
  Core: CVKTCPAVV
  misc_feature (7)..(7): Xaa can be Ala, Cys, Glu, Phe, His, Ile, Leu, Met, Asn, Pro, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YIDGPHXVKXCXAVXMGENNTL

SEQ ID NO: 25788 - protein, 22 aa, Artificial Sequence
  Description of Artificial Sequence: Synthetic peptide
  Seed: YIDGPHCVKTCPAVVMGENNTL (EGFR G598V)
  Core: VKTCPAVVM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YIDGPHCXKTXPXVVXGENNTL

SEQ ID NO: 25789 - protein, 23 aa, Artificial Sequence
  Description of Artificial Sequence: Synthetic peptide
  Seed: YIDGPHCVKTCPAVVMGENNTLV (EGFR G598V)
  Core: CVKTCPAVV
  misc_feature (7)..(7): Xaa can be Ala, Cys, Glu, Phe, His, Ile, Leu, Met, Asn, Pro, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YIDGPHXVKXCXAVXMGENNTLV

SEQ ID NO: 25790 - protein, 23 aa, Artificial Sequence
  Description of Artificial Sequence: Synthetic peptide
  Seed: YIDGPHCVKTCPAVVMGENNTLV (EGFR G598V)
  Core: VKTCPAVVM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YIDGPHCXKTXPXVVXGENNTLV

SEQ ID NO: 25791 - protein, 24 aa, Artificial Sequence
  Description of Artificial Sequence: Synthetic peptide
  Seed: YIDGPHCVKTCPAVVMGENNTLVW (EGFR G598V)
  Core: CVKTCPAVV
  misc_feature (7)..(7): Xaa can be Ala, Cys, Asp, Glu, Phe, His, Ile, Leu, Met, Asn, Pro, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YIDGPHXVKXCXAVXMGENNTLVW

SEQ ID NO: 25792 - protein, 24 aa, Artificial Sequence
  Description of Artificial Sequence: Synthetic peptide
  Seed: YIDGPHCVKTCPAVVMGENNTLVW (EGFR G598V)
  Core: VKTCPAVVM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YIDGPHCXKTXPXVVXGENNTLVW

SEQ ID NO: 25793 - protein, 25 aa, Artificial Sequence
  Description of Artificial Sequence: Synthetic peptide
  Seed: YIDGPHCVKTCPAVVMGENNTLVWK (EGFR G598V)
  Core: CVKTCPAVV
  misc_feature (7)..(7): Xaa can be Ala, Cys, Asp, Glu, Phe, His, Ile, Leu, Met, Asn, Pro, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YIDGPHXVKXCXAVXMGENNTLVWK

SEQ ID NO: 25794 - protein, 25 aa, Artificial Sequence
  Description of Artificial Sequence: Synthetic peptide
  Seed: YIDGPHCVKTCPAVVMGENNTLVWK (EGFR G598V)
  Core: VKTCPAVVM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YIDGPHCXKTXPXVVXGENNTLVWK

SEQ ID NO: 25795 - protein, 22 aa, Artificial Sequence
  Description of Artificial Sequence: Synthetic peptide
  Seed: AARNVLVKTPQHVKITDFGRAK (EGFR L858R)
  Core: VKITDFGRA
  misc_feature (13)..(13): Xaa can be Ala, Cys, Glu, Phe, His, Ile, Leu, Met, Gln, Arg, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AARNVLVKTPQHXKIXDXGRXK

SEQ ID NO: 25796 - protein, 23 aa, Artificial Sequence
  Description of Artificial Sequence: Synthetic peptide
  Seed: AARNVLVKTPQHVKITDFGRAKL (EGFR L858R)
  Core: VKITDFGRA
  misc_feature (13)..(13): Xaa can be Ala, Cys, Asp, Glu, Phe, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AARNVLVKTPQHXKIXDXGRXKL

SEQ ID NO: 25797 - protein, 24 aa, Artificial Sequence
  Description of Artificial Sequence: Synthetic peptide
  Seed: AARNVLVKTPQHVKITDFGRAKLL (EGFR L858R)
  Core: VKITDFGRA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AARNVLVKTPQHXKIXDXGRXKLL

SEQ ID NO: 25798 - protein, 25 aa, Artificial Sequence
  Description of Artificial Sequence: Synthetic peptide
  Seed: AARNVLVKTPQHVKITDFGRAKLLG (EGFR L858R)
  Core: VKITDFGRA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AARNVLVKTPQHXKIXDXGRXKLLG

SEQ ID NO: 25799 - protein, 20 aa, Artificial Sequence
  Description of Artificial Sequence: Synthetic peptide
  Seed: ARNVLVKTPQHVKITDFGRA (EGFR L858R)
  Core: VKITDFGRA
  misc_feature (12)..(12): Xaa can be Phe, Ile, Leu, Met, Arg, Val, Trp, or Tyr
  misc_feature (15)..(15): Xaa can be Ala, Cys, Asp, Glu, Phe, Gly, His, Ile, Lys, Leu, Met, Asn, Pro, Gln, Ser, Thr, Val, Trp, or Tyr
  misc_feature (17)..(17): Xaa can be Ala, Asp, Glu, Phe, Gly, His, Ile, Leu, Met, Asn, Pro, Gln, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ARNVLVKTPQHXKIXDXGRX

SEQ ID NO: 25800 - protein, 21 aa, Artificial Sequence
  Description of Artificial Sequence: Synthetic peptide
  Seed: ARNVLVKTPQHVKITDFGRAK (EGFR L858R)
  Core: VKITDFGRA
  misc_feature (12)..(12): Xaa can be Ala, Cys, Glu, Phe, His, Ile, Leu, Met, Gln, Arg, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ARNVLVKTPQHXKIXDXGRXK

SEQ ID NO: 25801 - protein, 22 aa, Artificial Sequence
  Description of Artificial Sequence: Synthetic peptide
  Seed: ARNVLVKTPQHVKITDFGRAKL (EGFR L858R)
  Core: VKITDFGRA
  misc_feature (12)..(12): Xaa can be Ala, Cys, Asp, Glu, Phe, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ARNVLVKTPQHXKIXDXGRXKL

SEQ ID NO: 25802 - protein, 23 aa, Artificial Sequence
  Description of Artificial Sequence: Synthetic peptide
  Seed: ARNVLVKTPQHVKITDFGRAKLL (EGFR L858R)
  Core: VKITDFGRA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ARNVLVKTPQHXKIXDXGRXKLL

SEQ ID NO: 25803 - protein, 24 aa, Artificial Sequence
  Description of Artificial Sequence: Synthetic peptide
  Seed: ARNVLVKTPQHVKITDFGRAKLLG (EGFR L858R)
  Core: VKITDFGRA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ARNVLVKTPQHXKIXDXGRXKLLG

SEQ ID NO: 25804 - protein, 25 aa, Artificial Sequence
  Description of Artificial Sequence: Synthetic peptide
  Seed: ARNVLVKTPQHVKITDFGRAKLLGA (EGFR L858R)
  Core: VKITDFGRA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ARNVLVKTPQHXKIXDXGRXKLLGA

SEQ ID NO: 25805 - protein, 25 aa, Artificial Sequence
  Description of Artificial Sequence: Synthetic peptide
  Seed: ARNVLVKTPQHVKITDFGRAKLLGA (EGFR L858R)
  Core: FGRAKLLGA
  misc_feature (17)..(17): Xaa can be Phe, His, Met, Gln, Trp, or Tyr
  misc_feature (20)..(20): Xaa can be Ala, Gly, Ser, or Thr
  misc_feature (22)..(22): Xaa can be Ala, Ile, Leu, Pro, or Val
  misc_feature (25)..(25): Xaa can be Ala, Gly, Ser, or Val
ARNVLVKTPQHVKITDXGRXKXLGX

SEQ ID NO: 25806 - protein, 14 aa, Artificial Sequence
  Description of Artificial Sequence: Synthetic peptide
  Seed: DFGRAKLLGAEEKE (EGFR L858R)
  Core: FGRAKLLGA
  misc_feature (2)..(2): Xaa can be Ala, Cys, Glu, Phe, His, Ile, Leu, Met, Asn, Pro, Gln, Ser, Thr, Val, Trp, or Tyr
  misc_feature (5)..(5): Xaa can be Ala, Gly, Ile, Ser, Thr, or Val
  misc_feature (7)..(7): Xaa can be Ala, Cys, Gly, Ile, Leu, Met, Pro, Ser, Thr, or Val
  misc_feature (10)..(10): Xaa can be Ala, Cys, Asp, Phe, Gly, His, Ile, Leu, Met, Asn, Pro, Ser, Thr, Val, Trp, or Tyr
DXGRXKXLGXEEKE

SEQ ID NO: 25807 - protein, 15 aa, Artificial Sequence
  Description of Artificial Sequence: Synthetic peptide
  Seed: DFGRAKLLGAEEKEY (EGFR L858R)
  Core: FGRAKLLGA
  misc_feature (2)..(2): Xaa can be Ala, Cys, Asp, Glu, Phe, Gly, His, Ile, Lys, Leu, Met, Asn, Pro, Gln, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Ser, Thr, Val, Trp, or Ty r
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXGRXKXLGXEEKEY

SEQ ID NO: 25808 - protein, 16 aa, Artificial Sequence
  Description of Artificial Sequence: Synthetic peptide
  Seed: DFGRAKLLGAEEKEYH (EGFR L858R)
  Core: FGRAKLLGA
  misc_feature (2)..(2): Xaa can be Ala, Cys, Asp, Glu, Phe, His, Ile, Leu, Met, Asn, Pro, Gln, Ser, Thr, Val, Trp, or Tyr
  misc_feature (5)..(5): Xaa can be Ala, Cys, Phe, Gly, Ile, Met, Ser, Thr, or Val
  misc_feature (7)..(7): Xaa can be Ala, Cys, Gly, Ile, Leu, Met, Asn, Pro, Ser, Thr, or Val
  misc_feature (10)..(10): Xaa can be Ala, Cys, Phe, Gly, His, Ile, Leu, Met, Asn, Pro, Gln, Ser, Thr, Val, Trp, or Tyr
DXGRXKXLGXEEKEYH

SEQ ID NO: 25809 - protein, 17 aa, Artificial Sequence
  Description of Artificial Sequence: Synthetic peptide
  Seed: DFGRAKLLGAEEKEYHA (EGFR L858R)
  Core: FGRAKLLGA
  misc_feature (2)..(2): Xaa can be Ala, Phe, Ile, Leu, Met, Asn, Pro, Gln, Ser, Thr, Val, Trp, or Tyr
  misc_feature (5)..(5): Xaa can be Ala, Gly, Ile, Ser, Thr, or Val
  misc_feature (7)..(7): Xaa can be Ala, Ile, Leu, Met, Pro, Ser, Thr, or Val
  misc_feature (10)..(10): Xaa can be Ala, Cys, Phe, Gly, Ile, Leu, Met, Asn, Ser, Thr, Val, or Trp
DXGRXKXLGXEEKEYHA

SEQ ID NO: 25810 - protein, 20 aa, Artificial Sequence
  Description of Artificial Sequence: Synthetic peptide
  Seed: DFGRAKLLGAEEKEYHAEGG (EGFR L858R)
  Core: FGRAKLLGA
  misc_feature (2)..(2): Xaa can be Phe, Ile, Leu, Trp, or Tyr
  misc_feature (5)..(5): Xaa can be Ala, Ile, Leu, Met, Gln, or Val
  misc_feature (7)..(7): Xaa can be Ala, Cys, Gly, His, Ile, Leu, Met, Asn, Pro, Gln, Ser, Thr, or Val
  misc_feature (10)..(10): Xaa can be Ala, Cys, Asp, Glu, Phe, Gly, His, Ile, Leu, Met, Asn, Gln, Ser, Thr, Val, Trp, or Tyr
DXGRXKXLGXEEKEYHAEGG

SEQ ID NO: 25811 - protein, 24 aa, Artificial Sequence
  Description of Artificial Sequence: Synthetic peptide
  Seed: DLAARNVLVKTPQHVKITDFGRAK (EGFR L858R)
  Core: VKITDFGRA
  misc_feature (15)..(15): Xaa can be Ala, Cys, Phe, His, Ile, Lys, Leu, Met, Gln, Arg, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DLAARNVLVKTPQHXKIXDXGRXK

SEQ ID NO: 25812 - protein, 25 aa, Artificial Sequence
  Description of Artificial Sequence: Synthetic peptide
  Seed: DLAARNVLVKTPQHVKITDFGRAKL (EGFR L858R)
  Core: VKITDFGRA
  misc_feature (15)..(15): Xaa can be Ala, Cys, Glu, Phe, His, Ile, Lys, Leu, Met, Asn, Pro, Gln, Arg, Ser, Thr, Val, Trp, or Ty r
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DLAARNVLVKTPQHXKIXDXGRXKL

SEQ ID NO: 25813 - protein, 13 aa, Artificial Sequence
  Description of Artificial Sequence: Synthetic peptide
  Seed: HVKITDFGRAKLL (EGFR L858R)
  Core: VKITDFGRA
  misc_feature (2)..(2): Xaa can be Cys, Phe, His, Ile, Leu, Met, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Glu, Phe, Gly, His, Ile, Leu, Met, Pro, Gln, Arg, Ser, Thr, Val, Trp, or Tyr
  misc_feature (10)..(10): Xaa can be Ala, Cys, Asp, Glu, Phe, Gly, His, Ile, Leu, Met, Asn, Pro, Gln, Arg, Ser, Thr, Val, Trp, or Tyr
HXKIXDXGRXKLL

SEQ ID NO: 25814 - protein, 14 aa, Artificial Sequence
  Description of Artificial Sequence: Synthetic peptide
  Seed: HVKITDFGRAKLLG (EGFR L858R)
  Core: VKITDFGRA
  misc_feature (2)..(2): Xaa can be Cys, Phe, Ile, Leu, Met, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Phe, His, Ile, Leu, Met, Asn, Pro, Gln, Arg, Ser, Val, Trp, or Tyr
  misc_feature (10)..(10): Xaa can be Ala, Cys, Asp, Glu, Phe, Gly, His, Ile, Leu, Met, Asn, Pro, Gln, Arg, Ser, Thr, Val, Trp, or Tyr
HXKIXDXGRXKLLG

SEQ ID NO: 25815 - protein, 15 aa, Artificial Sequence
  Description of Artificial Sequence: Synthetic peptide
  Seed: HVKITDFGRAKLLGA (EGFR L858R)
  Core: VKITDFGRA
  misc_feature (2)..(2): Xaa can be Phe, Ile, Leu, Met, Arg, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Phe, Ile, Leu, Met, Asn, Pro, Ser, Val, Trp, or Tyr
  misc_feature (10)..(10): Xaa can be Ala, Cys, Asp, Glu, Phe, Gly, His, Ile, Leu, Met, Asn, Pro, Gln, Arg, Ser, Thr, Val, Trp, or Tyr
HXKIXDXGRXKLLGA

SEQ ID NO: 25816 - protein, 15 aa, Artificial Sequence
  Description of Artificial Sequence: Synthetic peptide
  Seed: HVKITDFGRAKLLGA (EGFR L858R)
  Core: TDFGRAKLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HVKIXDFXRXKLXGA

SEQ ID NO: 25817 - protein, 15 aa, Artificial Sequence
  Description of Artificial Sequence: Synthetic peptide
  Seed: HVKITDFGRAKLLGA (EGFR L858R)
  Core: FGRAKLLGA
  misc_feature (7)..(7): Xaa can be Ala, Cys, Phe, His, Ile, Lys, Leu, Met, Asn, Pro, Gln, Arg, Ser, Thr, Val, Trp, or Tyr
  misc_feature (10)..(10): Xaa can be Ala, Cys, Glu, Phe, Gly, His, Ile, Leu, Met, Asn, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVKITDXGRXKXLGX

SEQ ID NO: 25818 - protein, 16 aa, Artificial Sequence
  Description of Artificial Sequence: Synthetic peptide
  Seed: HVKITDFGRAKLLGAE (EGFR L858R)
  Core: TDFGRAKLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HVKIXDFXRXKLXGAE

SEQ ID NO: 25819 - protein, 16 aa, Artificial Sequence
  Description of Artificial Sequence: Synthetic peptide
  Seed: HVKITDFGRAKLLGAE (EGFR L858R)
  Core: FGRAKLLGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVKITDXGRXKXLGXE

SEQ ID NO: 25820 - protein, 17 aa, Artificial Sequence
  Description of Artificial Sequence: Synthetic peptide
  Seed: HVKITDFGRAKLLGAEE (EGFR L858R)
  Core: FGRAKLLGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVKITDXGRXKXLGXEE

SEQ ID NO: 25821 - protein, 18 aa, Artificial Sequence
  Description of Artificial Sequence: Synthetic peptide
  Seed: HVKITDFGRAKLLGAEEK (EGFR L858R)
  Core: FGRAKLLGA
  misc_feature (7)..(7): Xaa can be Ala, Cys, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Leu, Met, Asn, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVKITDXGRXKXLGXEEK

SEQ ID NO: 25822 - protein, 19 aa, Artificial Sequence
  Description of Artificial Sequence: Synthetic peptide
  Seed: HVKITDFGRAKLLGAEEKE (EGFR L858R)
  Core: FGRAKLLGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVKITDXGRXKXLGXEEKE

SEQ ID NO: 25823 - protein, 20 aa, Artificial Sequence
  Description of Artificial Sequence: Synthetic peptide
  Seed: HVKITDFGRAKLLGAEEKEY (EGFR L858R)
  Core: FGRAKLLGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVKITDXGRXKXLGXEEKEY

SEQ ID NO: 25824 - protein, 21 aa, Artificial Sequence
  Description of Artificial Sequence: Synthetic peptide
  Seed: HVKITDFGRAKLLGAEEKEYH (EGFR L858R)
  Core: FGRAKLLGA
  misc_feature (7)..(7): Xaa can be Ala, Cys, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVKITDXGRXKXLGXEEKEYH

SEQ ID NO: 25825 - protein, 22 aa, Artificial Sequence
  Description of Artificial Sequence: Synthetic peptide
  Seed: HVKITDFGRAKLLGAEEKEYHA (EGFR L858R)
  Core: FGRAKLLGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVKITDXGRXKXLGXEEKEYHA

SEQ ID NO: 25826 - protein, 23 aa, Artificial Sequence
  Description of Artificial Sequence: Synthetic peptide
  Seed: HVKITDFGRAKLLGAEEKEYHAE (EGFR L858R)
  Core: FGRAKLLGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVKITDXGRXKXLGXEEKEYHAE

SEQ ID NO: 25827 - protein, 24 aa, Artificial Sequence
  Description of Artificial Sequence: Synthetic peptide
  Seed: HVKITDFGRAKLLGAEEKEYHAEG (EGFR L858R)
  Core: FGRAKLLGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVKITDXGRXKXLGXEEKEYHAEG

SEQ ID NO: 25828 - protein, 25 aa, Artificial Sequence
  Description of Artificial Sequence: Synthetic peptide
  Seed: HVKITDFGRAKLLGAEEKEYHAEGG (EGFR L858R)
  Core: FGRAKLLGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVKITDXGRXKXLGXEEKEYHAEGG

SEQ ID NO: 25829 - protein, 13 aa, Artificial Sequence
  Description of Artificial Sequence: Synthetic peptide
  Seed: ITDFGRAKLLGAE (EGFR L858R)
  Core: FGRAKLLGA
  misc_feature (4)..(4): Xaa can be Ala, Glu, Phe, Gly, His, Ile, Leu, Met, Asn, Pro, Ser, Thr, Val, Trp, or Tyr
  misc_feature (7)..(7): Xaa can be Ala, Gly, Ser, or Val
  misc_feature (9)..(9): Xaa can be Ala, Ile, Leu, Met, Pro, Ser, Thr, or Val
  misc_feature (12)..(12): Xaa can be Ala, Cys, Phe, Gly, Ile, Leu, Met, Asn, Pro, Ser, Thr, Val, or Trp
ITDXGRXKXLGXE

SEQ ID NO: 25830 - protein, 14 aa, Artificial Sequence
  Description of Artificial Sequence: Synthetic peptide
  Seed: ITDFGRAKLLGAEE (EGFR L858R)
  Core: FGRAKLLGA
  misc_feature (4)..(4): Xaa can be Ala, Cys, Asp, Glu, Phe, Gly, His, Ile, Lys, Leu, Met, Asn, Pro, Gln, Ser, Thr, Val, Trp, or Tyr
  misc_feature (7)..(7): Xaa can be Ala, Glu, Phe, Gly, Ile, Leu, Met, Pro, Gln, Ser, Thr, Val, or Trp
  misc_feature (9)..(9): Xaa can be Ala, Cys, Asp, Glu, Phe, Gly, His, Ile, Leu, Met, Asn, Pro, Gln, Ser, Thr, or Val
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ITDXGRXKXLGXEE

SEQ ID NO: 25831 - protein, 15 aa, Artificial Sequence
  Description of Artificial Sequence: Synthetic peptide
  Seed: ITDFGRAKLLGAEEK (EGFR L858R)
  Core: FGRAKLLGA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ITDXGRXKXLGXEEK

SEQ ID NO: 25832 - protein, 16 aa, Artificial Sequence
  Description of Artificial Sequence: Synthetic peptide
  Seed: ITDFGRAKLLGAEEKE (EGFR L858R)
  Core: FGRAKLLGA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Glu, Phe, Gly, His, Ile, Leu, Met, Asn, Pro, Gln, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ITDXGRXKXLGXEEKE

SEQ ID NO: 25833 - protein, 17 aa, Artificial Sequence
  Description of Artificial Sequence: Synthetic peptide
  Seed: ITDFGRAKLLGAEEKEY (EGFR L858R)
  Core: FGRAKLLGA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ITDXGRXKXLGXEEKEY

SEQ ID NO: 25834 - protein, 18 aa, Artificial Sequence
  Description of Artificial Sequence: Synthetic peptide
  Seed: ITDFGRAKLLGAEEKEYH (EGFR L858R)
  Core: FGRAKLLGA
  misc_feature (4)..(4): Xaa can be Ala, Cys, Phe, Gly, His, Ile, Leu, Met, Asn, Pro, Gln, Ser, Thr, Val, Trp, or Tyr
  misc_feature (7)..(7): Xaa can be Ala, Gly, Ile, Met, Ser, Thr, or Val
  misc_feature (9)..(9): Xaa can be Ala, Ile, Leu, Met, Pro, Ser, Thr, or Val
  misc_feature (12)..(12): Xaa can be Ala, Cys, Phe, Gly, His, Ile, Leu, Met, Asn, Gln, Ser, Thr, Val, or Trp
ITDXGRXKXLGXEEKEYH

SEQ ID NO: 25835 - protein, 19 aa, Artificial Sequence
  Description of Artificial Sequence: Synthetic peptide
  Seed: ITDFGRAKLLGAEEKEYHA (EGFR L858R)
  Core: FGRAKLLGA
  misc_feature (4)..(4): Xaa can be Ala, Cys, Asp, Glu, Phe, Gly, His, Ile, Lys, Leu, Met, Asn, Pro, Gln, Ser, Thr, Val, Trp, or Tyr
  misc_feature (7)..(7): Xaa can be Ala, Cys, Glu, Phe, Gly, Ile, Leu, Met, Asn, Gln, Ser, Thr, Val, or Trp
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
ITDXGRXKXLGXEEKEYHA

SEQ ID NO: 25836 - protein, 20 aa, Artificial Sequence
  Description of Artificial Sequence: Synthetic peptide
  Seed: ITDFGRAKLLGAEEKEYHAE (EGFR L858R)
  Core: FGRAKLLGA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Gln, Ser, Thr, Val, Trp, or Ty r
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ITDXGRXKXLGXEEKEYHAE

SEQ ID NO: 25837 - protein, 21 aa, Artificial Sequence
  Description of Artificial Sequence: Synthetic peptide
  Seed: ITDFGRAKLLGAEEKEYHAEG (EGFR L858R)
  Core: FGRAKLLGA
  misc_feature (4)..(4): Xaa can be Ala, Cys, Glu, Phe, Gly, His, Ile, Leu, Met, Asn, Pro, Gln, Ser, Thr, Val, Trp, or Tyr
  misc_feature (7)..(7): Xaa can be Ala, Cys, Glu, Phe, Gly, Ile, Leu, Met, Gln, Ser, Thr, Val, or Trp
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
ITDXGRXKXLGXEEKEYHAEG

SEQ ID NO: 25838 - protein, 22 aa, Artificial Sequence
  Description of Artificial Sequence: Synthetic peptide
  Seed: ITDFGRAKLLGAEEKEYHAEGG (EGFR L858R)
  Core: FGRAKLLGA
  misc_feature (4)..(4): Xaa can be Ala, Cys, Glu, Phe, Gly, His, Ile, Leu, Met, Asn, Pro, Gln, Ser, Thr, Val, Trp, or Tyr
  misc_feature (7)..(7): Xaa can be Ala, Cys, Glu, Phe, Gly, Ile, Leu, Met, Gln, Ser, Thr, Val, or Trp
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
ITDXGRXKXLGXEEKEYHAEGG

SEQ ID NO: 25839 - protein, 23 aa, Artificial Sequence
  Description of Artificial Sequence: Synthetic peptide
  Seed: ITDFGRAKLLGAEEKEYHAEGGK (EGFR L858R)
  Core: FGRAKLLGA
  misc_feature (4)..(4): Xaa can be Ala, Cys, Glu, Phe, Gly, His, Ile, Leu, Met, Asn, Pro, Gln, Ser, Thr, Val, Trp, or Tyr
  misc_feature (7)..(7): Xaa can be Ala, Cys, Glu, Phe, Gly, Ile, Leu, Met, Gln, Ser, Thr, Val, or Trp
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
ITDXGRXKXLGXEEKEYHAEGGK

SEQ ID NO: 25840 - protein, 24 aa, Artificial Sequence
  Description of Artificial Sequence: Synthetic peptide
  Seed: ITDFGRAKLLGAEEKEYHAEGGKV (EGFR L858R)
  Core: FGRAKLLGA
  misc_feature (4)..(4): Xaa can be Ala, Cys, Glu, Phe, Gly, His, Ile, Leu, Met, Asn, Pro, Gln, Ser, Thr, Val, Trp, or Tyr
  misc_feature (7)..(7): Xaa can be Ala, Cys, Glu, Phe, Gly, Ile, Leu, Met, Gln, Ser, Thr, Val, or Trp
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
ITDXGRXKXLGXEEKEYHAEGGKV

SEQ ID NO: 25841 - protein, 25 aa, Artificial Sequence
  Description of Artificial Sequence: Synthetic peptide
  Seed: ITDFGRAKLLGAEEKEYHAEGGKVP (EGFR L858R)
  Core: FGRAKLLGA
  misc_feature (4)..(4): Xaa can be Ala, Cys, Glu, Phe, Gly, His, Ile, Leu, Met, Asn, Pro, Gln, Ser, Thr, Val, Trp, or Tyr
  misc_feature (7)..(7): Xaa can be Ala, Cys, Glu, Phe, Gly, Ile, Leu, Met, Gln, Ser, Thr, Val, or Trp
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
ITDXGRXKXLGXEEKEYHAEGGKVP

SEQ ID NO: 25842 - protein, 14 aa, Artificial Sequence
  Description of Artificial Sequence: Synthetic peptide
  Seed: KITDFGRAKLLGAE (EGFR L858R)
  Core: FGRAKLLGA
  misc_feature (5)..(5): Xaa can be Ala, Cys, Asp, Glu, Phe, Gly, His, Ile, Lys, Leu, Met, Asn, Pro, Gln, Ser, Thr, Val, Trp, or Tyr
  misc_feature (8)..(8): Xaa can be Ala, Glu, Phe, Gly, Ile, Leu, Met, Gln, Ser, Thr, Val, or Trp
  misc_feature (10)..(10): Xaa can be Ala, Cys, Asp, Glu, Phe, Gly, His, Ile, Leu, Met, Asn, Pro, Gln, Ser, Thr, Val, Trp, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KITDXGRXKXLGXE

SEQ ID NO: 25843 - protein, 15 aa, Artificial Sequence
  Description of Artificial Sequence: Synthetic peptide
  Seed: KITDFGRAKLLGAEE (EGFR L858R)
  Core: FGRAKLLGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KITDXGRXKXLGXEE

SEQ ID NO: 25844 - protein, 16 aa, Artificial Sequence
  Description of Artificial Sequence: Synthetic peptide
  Seed: KITDFGRAKLLGAEEK (EGFR L858R)
  Core: FGRAKLLGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KITDXGRXKXLGXEEK

SEQ ID NO: 25845 - protein, 17 aa, Artificial Sequence
  Description of Artificial Sequence: Synthetic peptide
  Seed: KITDFGRAKLLGAEEKE (EGFR L858R)
  Core: FGRAKLLGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KITDXGRXKXLGXEEKE

SEQ ID NO: 25846 - protein, 18 aa, Artificial Sequence
  Description of Artificial Sequence: Synthetic peptide
  Seed: KITDFGRAKLLGAEEKEY (EGFR L858R)
  Core: FGRAKLLGA
  misc_feature (5)..(5): Xaa can be Ala, Cys, Phe, Gly, His, Ile, Leu, Met, Asn, Pro, Gln, Ser, Thr, Val, Trp, or Tyr
  misc_feature (8)..(8): Xaa can be Ala, Gly, Ile, Met, Ser, Thr, or Val
  misc_feature (10)..(10): Xaa can be Ala, Gly, Ile, Leu, Met, Pro, Ser, Thr, or Val
  misc_feature (13)..(13): Xaa can be Ala, Cys, Phe, Gly, His, Ile, Leu, Met, Asn, Pro, Gln, Ser, Thr, Val, Trp, or Tyr
KITDXGRXKXLGXEEKEY

SEQ ID NO: 25847 - protein, 19 aa, Artificial Sequence
  Description of Artificial Sequence: Synthetic peptide
  Seed: KITDFGRAKLLGAEEKEYH (EGFR L858R)
  Core: FGRAKLLGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KITDXGRXKXLGXEEKEYH

SEQ ID NO: 25848 - protein, 20 aa, Artificial Sequence
  Description of Artificial Sequence: Synthetic peptide
  Seed: KITDFGRAKLLGAEEKEYHA (EGFR L858R)
  Core: FGRAKLLGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KITDXGRXKXLGXEEKEYHA

SEQ ID NO: 25849 - protein, 21 aa, Artificial Sequence
  Description of Artificial Sequence: Synthetic peptide
  Seed: KITDFGRAKLLGAEEKEYHAE (EGFR L858R)
  Core: FGRAKLLGA
  misc_feature (5)..(5): Xaa can be Ala, Cys, Glu, Phe, Gly, His, Ile, Leu, Met, Asn, Pro, Gln, Ser, Thr, Val, Trp, or Tyr
  misc_feature (8)..(8): Xaa can be Ala, Cys, Glu, Phe, Gly, His, Ile, Leu, Met, Asn, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KITDXGRXKXLGXEEKEYHAE

SEQ ID NO: 25850 - protein, 22 aa, Artificial Sequence
  Description of Artificial Sequence: Synthetic peptide
  Seed: KITDFGRAKLLGAEEKEYHAEG (EGFR L858R)
  Core: FGRAKLLGA
  misc_feature (5)..(5): Xaa can be Ala, Cys, Glu, Phe, Gly, His, Ile, Leu, Met, Asn, Pro, Gln, Ser, Thr, Val, Trp, or Tyr
  misc_feature (8)..(8): Xaa can be Ala, Cys, Glu, Phe, Gly, His, Ile, Leu, Met, Asn, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KITDXGRXKXLGXEEKEYHAEG

SEQ ID NO: 25851 - protein, 23 aa, Artificial Sequence
  Description of Artificial Sequence: Synthetic peptide
  Seed: KITDFGRAKLLGAEEKEYHAEGG (EGFR L858R)
  Core: FGRAKLLGA
  misc_feature (5)..(5): Xaa can be Ala, Cys, Glu, Phe, Gly, His, Ile, Lys, Leu, Met, Asn, Pro, Gln, Ser, Thr, Val, Trp, or Ty r
  misc_feature (8)..(8): Xaa can be Ala, Cys, Glu, Phe, Gly, His, Ile, Leu, Met, Asn, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KITDXGRXKXLGXEEKEYHAEGG

SEQ ID NO: 25852 - protein, 24 aa, Artificial Sequence
  Description of Artificial Sequence: Synthetic peptide
  Seed: KITDFGRAKLLGAEEKEYHAEGGK (EGFR L858R)
  Core: FGRAKLLGA
  misc_feature (5)..(5): Xaa can be Ala, Cys, Glu, Phe, Gly, His, Ile, Leu, Met, Asn, Pro, Gln, Ser, Thr, Val, Trp, or Tyr
  misc_feature (8)..(8): Xaa can be Ala, Cys, Glu, Phe, Gly, His, Ile, Leu, Met, Asn, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KITDXGRXKXLGXEEKEYHAEGGK

SEQ ID NO: 25853 - protein, 25 aa, Artificial Sequence
  Description of Artificial Sequence: Synthetic peptide
  Seed: KITDFGRAKLLGAEEKEYHAEGGKV (EGFR L858R)
  Core: FGRAKLLGA
  misc_feature (5)..(5): Xaa can be Ala, Cys, Glu, Phe, Gly, His, Ile, Leu, Met, Asn, Pro, Gln, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Ser, Thr, Val, Trp, or Ty r
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KITDXGRXKXLGXEEKEYHAEGGKV

SEQ ID NO: 25854 - protein, 15 aa, Artificial Sequence
  Description of Artificial Sequence: Synthetic peptide
  Seed: KTPQHVKITDFGRAK (EGFR L858R)
  Core: VKITDFGRA
  misc_feature (6)..(6): Xaa can be Ala, Cys, Glu, Phe, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHXKIXDXGRXK

SEQ ID NO: 25855 - protein, 16 aa, Artificial Sequence
  Description of Artificial Sequence: Synthetic peptide
  Seed: KTPQHVKITDFGRAKL (EGFR L858R)
  Core: VKITDFGRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHXKIXDXGRXKL

SEQ ID NO: 25856 - protein, 17 aa, Artificial Sequence
  Description of Artificial Sequence: Synthetic peptide
  Seed: KTPQHVKITDFGRAKLL (EGFR L858R)
  Core: VKITDFGRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHXKIXDXGRXKLL

SEQ ID NO: 25857 - protein, 18 aa, Artificial Sequence
  Description of Artificial Sequence: Synthetic peptide
  Seed: KTPQHVKITDFGRAKLLG (EGFR L858R)
  Core: VKITDFGRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHXKIXDXGRXKLLG

SEQ ID NO: 25858 - protein, 19 aa, Artificial Sequence
  Description of Artificial Sequence: Synthetic peptide
  Seed: KTPQHVKITDFGRAKLLGA (EGFR L858R)
  Core: VKITDFGRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHXKIXDXGRXKLLGA

SEQ ID NO: 25859 - protein, 19 aa, Artificial Sequence
  Description of Artificial Sequence: Synthetic peptide
  Seed: KTPQHVKITDFGRAKLLGA (EGFR L858R)
  Core: TDFGRAKLL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHVKIXDFXRXKLXGA

SEQ ID NO: 25860 - protein, 19 aa, Artificial Sequence
  Description of Artificial Sequence: Synthetic peptide
  Seed: KTPQHVKITDFGRAKLLGA (EGFR L858R)
  Core: FGRAKLLGA
  misc_feature (11)..(11): Xaa can be Ala, Phe, His, Ile, Leu, Met, Asn, Pro, Gln, Thr, Val, Trp, or Tyr
  misc_feature (14)..(14): Xaa can be Ala, Gly, Ile, Ser, Thr, or Val
  misc_feature (16)..(16): Xaa can be Ala, Cys, Ile, Leu, Met, Pro, Ser, Thr, or Val
  misc_feature (19)..(19): Xaa can be Ala, Cys, Asp, Glu, Phe, Gly, His, Ile, Leu, Met, Asn, Gln, Ser, Thr, Val, Trp, or Tyr
KTPQHVKITDXGRXKXLGX

SEQ ID NO: 25861 - protein, 20 aa, Artificial Sequence
  Description of Artificial Sequence: Synthetic peptide
  Seed: KTPQHVKITDFGRAKLLGAE (EGFR L858R)
  Core: VKITDFGRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHXKIXDXGRXKLLGAE

SEQ ID NO: 25862 - protein, 20 aa, Artificial Sequence
  Description of Artificial Sequence: Synthetic peptide
  Seed: KTPQHVKITDFGRAKLLGAE (EGFR L858R)
  Core: TDFGRAKLL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHVKIXDFXRXKLXGAE

SEQ ID NO: 25863 - protein, 20 aa, Artificial Sequence
  Description of Artificial Sequence: Synthetic peptide
  Seed: KTPQHVKITDFGRAKLLGAE (EGFR L858R)
  Core: FGRAKLLGA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Glu, Phe, Gly, His, Ile, Leu, Met, Asn, Pro, Gln, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHVKITDXGRXKXLGXE

SEQ ID NO: 25864 - protein, 21 aa, Artificial Sequence
  Description of Artificial Sequence: Synthetic peptide
  Seed: KTPQHVKITDFGRAKLLGAEE (EGFR L858R)
  Core: VKITDFGRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHXKIXDXGRXKLLGAEE

SEQ ID NO: 25865 - protein, 21 aa, Artificial Sequence
  Description of Artificial Sequence: Synthetic peptide
  Seed: KTPQHVKITDFGRAKLLGAEE (EGFR L858R)
  Core: TDFGRAKLL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHVKIXDFXRXKLXGAEE

SEQ ID NO: 25866 - protein, 21 aa, Artificial Sequence
  Description of Artificial Sequence: Synthetic peptide
  Seed: KTPQHVKITDFGRAKLLGAEE (EGFR L858R)
  Core: FGRAKLLGA
  misc_feature (11)..(11): Xaa can be Ala, Cys, Glu, Phe, Gly, His, Ile, Leu, Met, Asn, Pro, Gln, Ser, Thr, Val, Trp, or Tyr
  misc_feature (14)..(14): Xaa can be Ala, Glu, Phe, Gly, His, Ile, Leu, Met, Gln, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHVKITDXGRXKXLGXEE

SEQ ID NO: 25867 - protein, 22 aa, Artificial Sequence
  Description of Artificial Sequence: Synthetic peptide
  Seed: KTPQHVKITDFGRAKLLGAEEK (EGFR L858R)
  Core: VKITDFGRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHXKIXDXGRXKLLGAEEK

SEQ ID NO: 25868 - protein, 22 aa, Artificial Sequence
  Description of Artificial Sequence: Synthetic peptide
  Seed: KTPQHVKITDFGRAKLLGAEEK (EGFR L858R)
  Core: FGRAKLLGA
  misc_feature (11)..(11): Xaa can be Ala, Cys, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Glu, Phe, Gly, His, Ile, Lys, Leu, Met, Asn, Gln, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHVKITDXGRXKXLGXEEK

SEQ ID NO: 25869 - protein, 23 aa, Artificial Sequence
  Description of Artificial Sequence: Synthetic peptide
  Seed: KTPQHVKITDFGRAKLLGAEEKE (EGFR L858R)
  Core: VKITDFGRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHXKIXDXGRXKLLGAEEKE

SEQ ID NO: 25870 - protein, 23 aa, Artificial Sequence
  Description of Artificial Sequence: Synthetic peptide
  Seed: KTPQHVKITDFGRAKLLGAEEKE (EGFR L858R)
  Core: FGRAKLLGA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Gln, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHVKITDXGRXKXLGXEEKE

SEQ ID NO: 25871 - protein, 24 aa, Artificial Sequence
  Description of Artificial Sequence: Synthetic peptide
  Seed: KTPQHVKITDFGRAKLLGAEEKEY (EGFR L858R)
  Core: VKITDFGRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHXKIXDXGRXKLLGAEEKEY

SEQ ID NO: 25872 - protein, 24 aa, Artificial Sequence
  Description of Artificial Sequence: Synthetic peptide
  Seed: KTPQHVKITDFGRAKLLGAEEKEY (EGFR L858R)
  Core: FGRAKLLGA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Gln, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHVKITDXGRXKXLGXEEKEY

SEQ ID NO: 25873 - protein, 25 aa, Artificial Sequence
  Description of Artificial Sequence: Synthetic peptide
  Seed: KTPQHVKITDFGRAKLLGAEEKEYH (EGFR L858R)
  Core: VKITDFGRA
  misc_feature (6)..(6): Xaa can be Ala, Cys, Asp, Glu, Phe, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHXKIXDXGRXKLLGAEEKEYH

SEQ ID NO: 25874 - protein, 25 aa, Artificial Sequence
  Description of Artificial Sequence: Synthetic peptide
  Seed: KTPQHVKITDFGRAKLLGAEEKEYH (EGFR L858R)
  Core: FGRAKLLGA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KTPQHVKITDXGRXKXLGXEEKEYH

SEQ ID NO: 25875 - protein, 23 aa, Artificial Sequence
  Description of Artificial Sequence: Synthetic peptide
  Seed: LAARNVLVKTPQHVKITDFGRAK (EGFR L858R)
  Core: VKITDFGRA
  misc_feature (14)..(14): Xaa can be Ala, Cys, Phe, His, Ile, Leu, Met, Gln, Arg, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LAARNVLVKTPQHXKIXDXGRXK

SEQ ID NO: 25876 - protein, 24 aa, Artificial Sequence
  Description of Artificial Sequence: Synthetic peptide
  Seed: LAARNVLVKTPQHVKITDFGRAKL (EGFR L858R)
  Core: VKITDFGRA
  misc_feature (14)..(14): Xaa can be Ala, Cys, Glu, Phe, His, Ile, Lys, Leu, Met, Asn, Pro, Gln, Arg, Ser, Thr, Val, Trp, or Ty r
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LAARNVLVKTPQHXKIXDXGRXKL

SEQ ID NO: 25877 - protein, 25 aa, Artificial Sequence
  Description of Artificial Sequence: Synthetic peptide
  Seed: LAARNVLVKTPQHVKITDFGRAKLL (EGFR L858R)
  Core: VKITDFGRA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LAARNVLVKTPQHXKIXDXGRXKLL

SEQ ID NO: 25878 - protein, 16 aa, Artificial Sequence
  Description of Artificial Sequence: Synthetic peptide
  Seed: LVKTPQHVKITDFGRA (EGFR L858R)
  Core: VKITDFGRA
  misc_feature (8)..(8): Xaa can be Ala, Cys, Phe, Ile, Leu, Met, Arg, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Phe, His, Ile, Leu, Met, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHXKIXDXGRX

SEQ ID NO: 25879 - protein, 17 aa, Artificial Sequence
  Description of Artificial Sequence: Synthetic peptide
  Seed: LVKTPQHVKITDFGRAK (EGFR L858R)
  Core: VKITDFGRA
  misc_feature (8)..(8): Xaa can be Ala, Cys, Glu, Phe, His, Ile, Leu, Met, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHXKIXDXGRXK

SEQ ID NO: 25880 - protein, 18 aa, Artificial Sequence
  Description of Artificial Sequence: Synthetic peptide
  Seed: LVKTPQHVKITDFGRAKL (EGFR L858R)
  Core: VKITDFGRA
  misc_feature (8)..(8): Xaa can be Ala, Cys, Glu, Phe, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Glu, Phe, His, Ile, Leu, Met, Pro, Gln, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHXKIXDXGRXKL

SEQ ID NO: 25881 - protein, 19 aa, Artificial Sequence
  Description of Artificial Sequence: Synthetic peptide
  Seed: LVKTPQHVKITDFGRAKLL (EGFR L858R)
  Core: VKITDFGRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHXKIXDXGRXKLL

SEQ ID NO: 25882 - protein, 20 aa, Artificial Sequence
  Description of Artificial Sequence: Synthetic peptide
  Seed: LVKTPQHVKITDFGRAKLLG (EGFR L858R)
  Core: VKITDFGRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHXKIXDXGRXKLLG

SEQ ID NO: 25883 - protein, 21 aa, Artificial Sequence
  Description of Artificial Sequence: Synthetic peptide
  Seed: LVKTPQHVKITDFGRAKLLGA (EGFR L858R)
  Core: VKITDFGRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHXKIXDXGRXKLLGA

SEQ ID NO: 25884 - protein, 21 aa, Artificial Sequence
  Description of Artificial Sequence: Synthetic peptide
  Seed: LVKTPQHVKITDFGRAKLLGA (EGFR L858R)
  Core: TDFGRAKLL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHVKIXDFXRXKLXGA

SEQ ID NO: 25885 - protein, 22 aa, Artificial Sequence
  Description of Artificial Sequence: Synthetic peptide
  Seed: LVKTPQHVKITDFGRAKLLGAE (EGFR L858R)
  Core: VKITDFGRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHXKIXDXGRXKLLGAE

SEQ ID NO: 25886 - protein, 22 aa, Artificial Sequence
  Description of Artificial Sequence: Synthetic peptide
  Seed: LVKTPQHVKITDFGRAKLLGAE (EGFR L858R)
  Core: TDFGRAKLL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHVKIXDFXRXKLXGAE

SEQ ID NO: 25887 - protein, 22 aa, Artificial Sequence
  Description of Artificial Sequence: Synthetic peptide
  Seed: LVKTPQHVKITDFGRAKLLGAE (EGFR L858R)
  Core: FGRAKLLGA
  misc_feature (13)..(13): Xaa can be Ala, Cys, Phe, Gly, His, Ile, Leu, Met, Asn, Pro, Gln, Ser, Thr, Val, Trp, or Tyr
  misc_feature (16)..(16): Xaa can be Ala, Glu, Phe, Gly, Ile, Leu, Met, Gln, Ser, Thr, Val, or Trp
  misc_feature (18)..(18): Xaa can be Ala, Cys, Glu, Phe, Gly, His, Ile, Lys, Leu, Met, Asn, Pro, Gln, Arg, Ser, Thr, Val, or Ty r
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHVKITDXGRXKXLGXE

SEQ ID NO: 25888 - protein, 23 aa, Artificial Sequence
  Description of Artificial Sequence: Synthetic peptide
  Seed: LVKTPQHVKITDFGRAKLLGAEE (EGFR L858R)
  Core: VKITDFGRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHXKIXDXGRXKLLGAEE

SEQ ID NO: 25889 - protein, 23 aa, Artificial Sequence
  Description of Artificial Sequence: Synthetic peptide
  Seed: LVKTPQHVKITDFGRAKLLGAEE (EGFR L858R)
  Core: TDFGRAKLL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHVKIXDFXRXKLXGAEE

SEQ ID NO: 25890 - protein, 23 aa, Artificial Sequence
  Description of Artificial Sequence: Synthetic peptide
  Seed: LVKTPQHVKITDFGRAKLLGAEE (EGFR L858R)
  Core: FGRAKLLGA
  misc_feature (13)..(13): Xaa can be Ala, Cys, Glu, Phe, Gly, His, Ile, Leu, Met, Asn, Pro, Gln, Ser, Thr, Val, Trp, or Tyr
  misc_feature (16)..(16): Xaa can be Ala, Glu, Phe, Gly, His, Ile, Leu, Met, Asn, Gln, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHVKITDXGRXKXLGXEE

SEQ ID NO: 25891 - protein, 24 aa, Artificial Sequence
  Description of Artificial Sequence: Synthetic peptide
  Seed: LVKTPQHVKITDFGRAKLLGAEEK (EGFR L858R)
  Core: VKITDFGRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHXKIXDXGRXKLLGAEEK

SEQ ID NO: 25892 - protein, 24 aa, Artificial Sequence
  Description of Artificial Sequence: Synthetic peptide
  Seed: LVKTPQHVKITDFGRAKLLGAEEK (EGFR L858R)
  Core: FGRAKLLGA
  misc_feature (13)..(13): Xaa can be Ala, Cys, Asp, Glu, Phe, Gly, His, Ile, Lys, Leu, Met, Asn, Pro, Gln, Ser, Thr, Val, Trp, or Tyr
  misc_feature (16)..(16): Xaa can be Ala, Cys, Asp, Glu, Phe, Gly, His, Ile, Lys, Leu, Met, Asn, Gln, Ser, Thr, Val, Trp, or Ty r
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHVKITDXGRXKXLGXEEK

SEQ ID NO: 25893 - protein, 25 aa, Artificial Sequence
  Description of Artificial Sequence: Synthetic peptide
  Seed: LVKTPQHVKITDFGRAKLLGAEEKE (EGFR L858R)
  Core: VKITDFGRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHXKIXDXGRXKLLGAEEKE

SEQ ID NO: 25894 - protein, 25 aa, Artificial Sequence
  Description of Artificial Sequence: Synthetic peptide
  Seed: LVKTPQHVKITDFGRAKLLGAEEKE (EGFR L858R)
  Core: FGRAKLLGA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Gln, Ser, Thr, Val, Trp, or Ty r
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVKTPQHVKITDXGRXKXLGXEEKE

SEQ ID NO: 25895 - protein, 19 aa, Artificial Sequence
  Description of Artificial Sequence: Synthetic peptide
  Seed: NVLVKTPQHVKITDFGRAK (EGFR L858R)
  Core: VKITDFGRA
  misc_feature (10)..(10): Xaa can be Ala, Cys, Phe, His, Ile, Leu, Met, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NVLVKTPQHXKIXDXGRXK

SEQ ID NO: 25896 - protein, 20 aa, Artificial Sequence
  Description of Artificial Sequence: Synthetic peptide
  Seed: NVLVKTPQHVKITDFGRAKL (EGFR L858R)
  Core: VKITDFGRA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NVLVKTPQHXKIXDXGRXKL

SEQ ID NO: 25897 - protein, 21 aa, Artificial Sequence
  Description of Artificial Sequence: Synthetic peptide
  Seed: NVLVKTPQHVKITDFGRAKLL (EGFR L858R)
  Core: VKITDFGRA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NVLVKTPQHXKIXDXGRXKLL

SEQ ID NO: 25898 - protein, 22 aa, Artificial Sequence
  Description of Artificial Sequence: Synthetic peptide
  Seed: NVLVKTPQHVKITDFGRAKLLG (EGFR L858R)
  Core: VKITDFGRA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NVLVKTPQHXKIXDXGRXKLLG

SEQ ID NO: 25899 - protein, 23 aa, Artificial Sequence
  Description of Artificial Sequence: Synthetic peptide
  Seed: NVLVKTPQHVKITDFGRAKLLGA (EGFR L858R)
  Core: VKITDFGRA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NVLVKTPQHXKIXDXGRXKLLGA

SEQ ID NO: 25900 - protein, 23 aa, Artificial Sequence
  Description of Artificial Sequence: Synthetic peptide
  Seed: NVLVKTPQHVKITDFGRAKLLGA (EGFR L858R)
  Core: TDFGRAKLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NVLVKTPQHVKIXDFXRXKLXGA

SEQ ID NO: 25901 - protein, 23 aa, Artificial Sequence
  Description of Artificial Sequence: Synthetic peptide
  Seed: NVLVKTPQHVKITDFGRAKLLGA (EGFR L858R)
  Core: FGRAKLLGA
  misc_feature (15)..(15): Xaa can be Phe, His, Met, Trp, or Tyr
  misc_feature (18)..(18): Xaa can be Ala, Gly, or Ser
  misc_feature (20)..(20): Xaa can be Ala, Ile, Leu, Pro, or Val
  misc_feature (23)..(23): Xaa can be Ala, or Ser
NVLVKTPQHVKITDXGRXKXLGX

SEQ ID NO: 25902 - protein, 24 aa, Artificial Sequence
  Description of Artificial Sequence: Synthetic peptide
  Seed: NVLVKTPQHVKITDFGRAKLLGAE (EGFR L858R)
  Core: VKITDFGRA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NVLVKTPQHXKIXDXGRXKLLGAE

SEQ ID NO: 25903 - protein, 24 aa, Artificial Sequence
  Description of Artificial Sequence: Synthetic peptide
  Seed: NVLVKTPQHVKITDFGRAKLLGAE (EGFR L858R)
  Core: TDFGRAKLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NVLVKTPQHVKIXDFXRXKLXGAE

SEQ ID NO: 25904 - protein, 24 aa, Artificial Sequence
  Description of Artificial Sequence: Synthetic peptide
  Seed: NVLVKTPQHVKITDFGRAKLLGAE (EGFR L858R)
  Core: FGRAKLLGA
  misc_feature (15)..(15): Xaa can be Ala, Cys, Phe, Gly, His, Ile, Leu, Met, Asn, Pro, Gln, Ser, Thr, Val, Trp, or Tyr
  misc_feature (18)..(18): Xaa can be Ala, Glu, Phe, Gly, Ile, Leu, Met, Gln, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
NVLVKTPQHVKITDXGRXKXLGXE

SEQ ID NO: 25905 - protein, 25 aa, Artificial Sequence
  Description of Artificial Sequence: Synthetic peptide
  Seed: NVLVKTPQHVKITDFGRAKLLGAEE (EGFR L858R)
  Core: VKITDFGRA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NVLVKTPQHXKIXDXGRXKLLGAEE

SEQ ID NO: 25906 - protein, 25 aa, Artificial Sequence
  Description of Artificial Sequence: Synthetic peptide
  Seed: NVLVKTPQHVKITDFGRAKLLGAEE (EGFR L858R)
  Core: TDFGRAKLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NVLVKTPQHVKIXDFXRXKLXGAEE

SEQ ID NO: 25907 - protein, 25 aa, Artificial Sequence
  Description of Artificial Sequence: Synthetic peptide
  Seed: NVLVKTPQHVKITDFGRAKLLGAEE (EGFR L858R)
  Core: FGRAKLLGA
  misc_feature (15)..(15): Xaa can be Ala, Cys, Glu, Phe, Gly, His, Ile, Leu, Met, Asn, Pro, Gln, Ser, Thr, Val, Trp, or Tyr
  misc_feature (18)..(18): Xaa can be Ala, Cys, Glu, Phe, Gly, His, Ile, Leu, Met, Asn, Gln, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
NVLVKTPQHVKITDXGRXKXLGXEE

SEQ ID NO: 25908 - protein, 14 aa, Artificial Sequence
  Description of Artificial Sequence: Synthetic peptide
  Seed: PQHVKITDFGRAKL (EGFR L858R)
  Core: VKITDFGRA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Glu, Phe, Gly, His, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PQHXKIXDXGRXKL

SEQ ID NO: 25909 - protein, 15 aa, Artificial Sequence
  Description of Artificial Sequence: Synthetic peptide
  Seed: PQHVKITDFGRAKLL (EGFR L858R)
  Core: VKITDFGRA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PQHXKIXDXGRXKLL

SEQ ID NO: 25910 - protein, 16 aa, Artificial Sequence
  Description of Artificial Sequence: Synthetic peptide
  Seed: PQHVKITDFGRAKLLG (EGFR L858R)
  Core: VKITDFGRA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PQHXKIXDXGRXKLLG

SEQ ID NO: 25911 - protein, 17 aa, Artificial Sequence
  Description of Artificial Sequence: Synthetic peptide
  Seed: PQHVKITDFGRAKLLGA (EGFR L858R)
  Core: VKITDFGRA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PQHXKIXDXGRXKLLGA

SEQ ID NO: 25912 - protein, 17 aa, Artificial Sequence
  Description of Artificial Sequence: Synthetic peptide
  Seed: PQHVKITDFGRAKLLGA (EGFR L858R)
  Core: TDFGRAKLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PQHVKIXDFXRXKLXGA

SEQ ID NO: 25913 - protein, 17 aa, Artificial Sequence
  Description of Artificial Sequence: Synthetic peptide
  Seed: PQHVKITDFGRAKLLGA (EGFR L858R)
  Core: FGRAKLLGA
  misc_feature (9)..(9): Xaa can be Ala, Phe, His, Ile, Leu, Met, Asn, Pro, Gln, Ser, Thr, Val, Trp, or Tyr
  misc_feature (12)..(12): Xaa can be Ala, Gly, Ile, Ser, Thr, or Val
  misc_feature (14)..(14): Xaa can be Ala, Cys, Gly, Ile, Leu, Met, Pro, Ser, Thr, or Val
  misc_feature (17)..(17): Xaa can be Ala, Cys, Phe, Gly, His, Ile, Leu, Met, Asn, Pro, Gln, Ser, Thr, Val, Trp, or Tyr
PQHVKITDXGRXKXLGX

SEQ ID NO: 25914 - protein, 18 aa, Artificial Sequence
  Description of Artificial Sequence: Synthetic peptide
  Seed: PQHVKITDFGRAKLLGAE (EGFR L858R)
  Core: VKITDFGRA
  misc_feature (4)..(4): Xaa can be Ala, Cys, Glu, Phe, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PQHXKIXDXGRXKLLGAE

SEQ ID NO: 25915 - protein, 18 aa, Artificial Sequence
  Description of Artificial Sequence: Synthetic peptide
  Seed: PQHVKITDFGRAKLLGAE (EGFR L858R)
  Core: FGRAKLLGA
  misc_feature (9)..(9): Xaa can be Ala, Phe, His, Ile, Leu, Met, Asn, Pro, Ser, Thr, Val, Trp, or Tyr
  misc_feature (12)..(12): Xaa can be Ala, Gly, Ile, Ser, Thr, or Val
  misc_feature (14)..(14): Xaa can be Ala, Ile, Leu, Met, Pro, Ser, Thr, or Val
  misc_feature (17)..(17): Xaa can be Ala, Cys, Asp, Phe, Gly, His, Ile, Leu, Met, Asn, Gln, Ser, Thr, Val, Trp, or Tyr
PQHVKITDXGRXKXLGXE

SEQ ID NO: 25916 - protein, 19 aa, Artificial Sequence
  Description of Artificial Sequence: Synthetic peptide
  Seed: PQHVKITDFGRAKLLGAEE (EGFR L858R)
  Core: VKITDFGRA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PQHXKIXDXGRXKLLGAEE

SEQ ID NO: 25917 - protein, 19 aa, Artificial Sequence
  Description of Artificial Sequence: Synthetic peptide
  Seed: PQHVKITDFGRAKLLGAEE (EGFR L858R)
  Core: FGRAKLLGA
  misc_feature (9)..(9): Xaa can be Ala, Cys, Asp, Glu, Phe, Gly, His, Ile, Leu, Met, Asn, Pro, Gln, Ser, Thr, Val, Trp, or Ty r
  misc_feature (12)..(12): Xaa can be Ala, Cys, Glu, Phe, Gly, His, Ile, Leu, Met, Asn, Gln, Ser, Thr, Val, or Trp
  misc_feature (14)..(14): Xaa can be Ala, Cys, Asp, Glu, Phe, Gly, His, Ile, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PQHVKITDXGRXKXLGXEE

SEQ ID NO: 25918 - protein, 20 aa, Artificial Sequence
  Description of Artificial Sequence: Synthetic peptide
  Seed: PQHVKITDFGRAKLLGAEEK (EGFR L858R)
  Core: VKITDFGRA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PQHXKIXDXGRXKLLGAEEK

SEQ ID NO: 25919 - protein, 20 aa, Artificial Sequence
  Description of Artificial Sequence: Synthetic peptide
  Seed: PQHVKITDFGRAKLLGAEEK (EGFR L858R)
  Core: FGRAKLLGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PQHVKITDXGRXKXLGXEEK

SEQ ID NO: 25920 - protein, 21 aa, Artificial Sequence
  Description of Artificial Sequence: Synthetic peptide
  Seed: PQHVKITDFGRAKLLGAEEKE (EGFR L858R)
  Core: VKITDFGRA
  misc_feature (4)..(4): Xaa can be Ala, Cys, Asp, Glu, Phe, His, Ile, Lys, Leu, Met, Pro, Gln, Arg, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PQHXKIXDXGRXKLLGAEEKE

SEQ ID NO: 25921 - protein, 21 aa, Artificial Sequence
  Description of Artificial Sequence: Synthetic peptide
  Seed: PQHVKITDFGRAKLLGAEEKE (EGFR L858R)
  Core: FGRAKLLGA
  misc_feature (9)..(9): Xaa can be Ala, Cys, Glu, Phe, Gly, His, Ile, Leu, Met, Asn, Pro, Gln, Ser, Thr, Val, Trp, or Tyr
  misc_feature (12)..(12): Xaa can be Ala, Cys, Glu, Phe, Gly, His, Ile, Lys, Leu, Met, Asn, Pro, Gln, Ser, Thr, Val, Trp, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PQHVKITDXGRXKXLGXEEKE

SEQ ID NO: 25922 - protein, 22 aa, Artificial Sequence
  Description of Artificial Sequence: Synthetic peptide
  Seed: PQHVKITDFGRAKLLGAEEKEY (EGFR L858R)
  Core: VKITDFGRA
  misc_feature (4)..(4): Xaa can be Ala, Cys, Asp, Glu, Phe, His, Ile, Lys, Leu, Met, Pro, Gln, Arg, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PQHXKIXDXGRXKLLGAEEKEY

SEQ ID NO: 25923 - protein, 22 aa, Artificial Sequence
  Description of Artificial Sequence: Synthetic peptide
  Seed: PQHVKITDFGRAKLLGAEEKEY (EGFR L858R)
  Core: FGRAKLLGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PQHVKITDXGRXKXLGXEEKEY

SEQ ID NO: 25924 - protein, 23 aa, Artificial Sequence
  Description of Artificial Sequence: Synthetic peptide
  Seed: PQHVKITDFGRAKLLGAEEKEYH (EGFR L858R)
  Core: VKITDFGRA
  misc_feature (4)..(4): Xaa can be Ala, Cys, Asp, Glu, Phe, His, Ile, Lys, Leu, Met, Pro, Gln, Arg, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PQHXKIXDXGRXKLLGAEEKEYH

SEQ ID NO: 25925 - protein, 23 aa, Artificial Sequence
  Description of Artificial Sequence: Synthetic peptide
  Seed: PQHVKITDFGRAKLLGAEEKEYH (EGFR L858R)
  Core: FGRAKLLGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PQHVKITDXGRXKXLGXEEKEYH

SEQ ID NO: 25926 - protein, 24 aa, Artificial Sequence
  Description of Artificial Sequence: Synthetic peptide
  Seed: PQHVKITDFGRAKLLGAEEKEYHA (EGFR L858R)
  Core: VKITDFGRA
  misc_feature (4)..(4): Xaa can be Ala, Cys, Asp, Glu, Phe, His, Ile, Lys, Leu, Met, Pro, Gln, Arg, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PQHXKIXDXGRXKLLGAEEKEYHA

SEQ ID NO: 25927 - protein, 24 aa, Artificial Sequence
  Description of Artificial Sequence: Synthetic peptide
  Seed: PQHVKITDFGRAKLLGAEEKEYHA (EGFR L858R)
  Core: FGRAKLLGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PQHVKITDXGRXKXLGXEEKEYHA

SEQ ID NO: 25928 - protein, 25 aa, Artificial Sequence
  Description of Artificial Sequence: Synthetic peptide
  Seed: PQHVKITDFGRAKLLGAEEKEYHAE (EGFR L858R)
  Core: VKITDFGRA
  misc_feature (4)..(4): Xaa can be Ala, Cys, Asp, Glu, Phe, His, Ile, Lys, Leu, Met, Pro, Gln, Arg, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PQHXKIXDXGRXKLLGAEEKEYHAE

SEQ ID NO: 25929 - protein, 25 aa, Artificial Sequence
  Description of Artificial Sequence: Synthetic peptide
  Seed: PQHVKITDFGRAKLLGAEEKEYHAE (EGFR L858R)
  Core: FGRAKLLGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PQHVKITDXGRXKXLGXEEKEYHAE

SEQ ID NO: 25930 - protein, 13 aa, Artificial Sequence
  Description of Artificial Sequence: Synthetic peptide
  Seed: QHVKITDFGRAKL (EGFR L858R)
  Core: VKITDFGRA
  misc_feature (3)..(3): Xaa can be Ala, Cys, Phe, His, Ile, Leu, Met, Gln, Arg, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Phe, Ile, Leu, Met, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QHXKIXDXGRXKL

SEQ ID NO: 25931 - protein, 14 aa, Artificial Sequence
  Description of Artificial Sequence: Synthetic peptide
  Seed: QHVKITDFGRAKLL (EGFR L858R)
  Core: VKITDFGRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QHXKIXDXGRXKLL

SEQ ID NO: 25932 - protein, 15 aa, Artificial Sequence
  Description of Artificial Sequence: Synthetic peptide
  Seed: QHVKITDFGRAKLLG (EGFR L858R)
  Core: VKITDFGRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QHXKIXDXGRXKLLG

SEQ ID NO: 25933 - protein, 15 aa, Artificial Sequence
  Description of Artificial Sequence: Synthetic peptide
  Seed: QHVKITDFGRAKLLG (EGFR L858R)
  Core: TDFGRAKLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QHVKIXDFXRXKLXG

SEQ ID NO: 25934 - protein, 16 aa, Artificial Sequence
  Description of Artificial Sequence: Synthetic peptide
  Seed: QHVKITDFGRAKLLGA (EGFR L858R)
  Core: VKITDFGRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QHXKIXDXGRXKLLGA

SEQ ID NO: 25935 - protein, 16 aa, Artificial Sequence
  Description of Artificial Sequence: Synthetic peptide
  Seed: QHVKITDFGRAKLLGA (EGFR L858R)
  Core: TDFGRAKLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QHVKIXDFXRXKLXGA

SEQ ID NO: 25936 - protein, 16 aa, Artificial Sequence
  Description of Artificial Sequence: Synthetic peptide
  Seed: QHVKITDFGRAKLLGA (EGFR L858R)
  Core: FGRAKLLGA
  misc_feature (8)..(8): Xaa can be Ala, Cys, Phe, His, Ile, Leu, Met, Asn, Gln, Ser, Thr, Val, Trp, or Tyr
  misc_feature (11)..(11): Xaa can be Ala, Cys, Phe, Gly, Ile, Leu, Met, Gln, Ser, Thr, Val, or Trp
  misc_feature (13)..(13): Xaa can be Ala, Cys, Phe, Gly, His, Ile, Lys, Leu, Met, Asn, Pro, Gln, Arg, Ser, Thr, Val, Trp, or Ty r
  misc_feature (16)..(16): Xaa can be Ala, Cys, Asp, Glu, Phe, Gly, His, Ile, Leu, Met, Asn, Pro, Gln, Arg, Ser, Thr, Val, Trp, or Tyr
QHVKITDXGRXKXLGX

SEQ ID NO: 25937 - protein, 17 aa, Artificial Sequence
  Description of Artificial Sequence: Synthetic peptide
  Seed: QHVKITDFGRAKLLGAE (EGFR L858R)
  Core: VKITDFGRA
  misc_feature (3)..(3): Xaa can be Ala, Cys, Asp, Glu, Phe, His, Ile, Lys, Leu, Met, Gln, Arg, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QHXKIXDXGRXKLLGAE

SEQ ID NO: 25938 - protein, 17 aa, Artificial Sequence
  Description of Artificial Sequence: Synthetic peptide
  Seed: QHVKITDFGRAKLLGAE (EGFR L858R)
  Core: TDFGRAKLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QHVKIXDFXRXKLXGAE

SEQ ID NO: 25939 - protein, 17 aa, Artificial Sequence
  Description of Artificial Sequence: Synthetic peptide
  Seed: QHVKITDFGRAKLLGAE (EGFR L858R)
  Core: FGRAKLLGA
  misc_feature (8)..(8): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Glu, Phe, Gly, His, Ile, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QHVKITDXGRXKXLGXE

SEQ ID NO: 25940 - protein, 18 aa, Artificial Sequence
  Description of Artificial Sequence: Synthetic peptide
  Seed: QHVKITDFGRAKLLGAEE (EGFR L858R)
  Core: VKITDFGRA
  misc_feature (3)..(3): Xaa can be Phe, Ile, Leu, Met, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Glu, Phe, Gly, His, Ile, Lys, Leu, Met, Asn, Pro, Gln, Arg, Ser, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QHXKIXDXGRXKLLGAEE

SEQ ID NO: 25941 - protein, 18 aa, Artificial Sequence
  Description of Artificial Sequence: Synthetic peptide
  Seed: QHVKITDFGRAKLLGAEE (EGFR L858R)
  Core: FGRAKLLGA
  misc_feature (8)..(8): Xaa can be Ala, Cys, Phe, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Phe, Gly, Ile, Leu, Met, Asn, Pro, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QHVKITDXGRXKXLGXEE

SEQ ID NO: 25942 - protein, 19 aa, Artificial Sequence
  Description of Artificial Sequence: Synthetic peptide
  Seed: QHVKITDFGRAKLLGAEEK (EGFR L858R)
  Core: VKITDFGRA
  misc_feature (3)..(3): Xaa can be Phe, Ile, Leu, Met, Val, Trp, or Tyr
  misc_feature (6)..(6): Xaa can be Ala, Cys, Asp, Glu, Phe, His, Ile, Lys, Leu, Met, Asn, Gln, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QHXKIXDXGRXKLLGAEEK

SEQ ID NO: 25943 - protein, 19 aa, Artificial Sequence
  Description of Artificial Sequence: Synthetic peptide
  Seed: QHVKITDFGRAKLLGAEEK (EGFR L858R)
  Core: FGRAKLLGA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QHVKITDXGRXKXLGXEEK

SEQ ID NO: 25944 - protein, 20 aa, Artificial Sequence
  Description of Artificial Sequence: Synthetic peptide
  Seed: QHVKITDFGRAKLLGAEEKE (EGFR L858R)
  Core: VKITDFGRA
  misc_feature (3)..(3): Xaa can be Phe, Ile, Leu, Met, Val, Trp, or Tyr
  misc_feature (6)..(6): Xaa can be Ala, Cys, Asp, Glu, Phe, Gly, His, Ile, Lys, Leu, Met, Asn, Gln, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QHXKIXDXGRXKLLGAEEKE

SEQ ID NO: 25945 - protein, 20 aa, Artificial Sequence
  Description of Artificial Sequence: Synthetic peptide
  Seed: QHVKITDFGRAKLLGAEEKE (EGFR L858R)
  Core: FGRAKLLGA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QHVKITDXGRXKXLGXEEKE

SEQ ID NO: 25946 - protein, 21 aa, Artificial Sequence
  Description of Artificial Sequence: Synthetic peptide
  Seed: QHVKITDFGRAKLLGAEEKEY (EGFR L858R)
  Core: VKITDFGRA
  misc_feature (3)..(3): Xaa can be Phe, Ile, Leu, Met, Val, Trp, or Tyr
  misc_feature (6)..(6): Xaa can be Ala, Cys, Asp, Glu, Phe, His, Ile, Lys, Leu, Met, Asn, Gln, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, Ile, Lys, Leu, Met, Asn, Pro, Gln, Arg, Ser, Thr, Val, Trp, or Tyr
QHXKIXDXGRXKLLGAEEKEY

SEQ ID NO: 25947 - protein, 21 aa, Artificial Sequence
  Description of Artificial Sequence: Synthetic peptide
  Seed: QHVKITDFGRAKLLGAEEKEY (EGFR L858R)
  Core: FGRAKLLGA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QHVKITDXGRXKXLGXEEKEY

SEQ ID NO: 25948 - protein, 22 aa, Artificial Sequence
  Description of Artificial Sequence: Synthetic peptide
  Seed: QHVKITDFGRAKLLGAEEKEYH (EGFR L858R)
  Core: VKITDFGRA
  misc_feature (3)..(3): Xaa can be Phe, Ile, Leu, Met, Val, Trp, or Tyr
  misc_feature (6)..(6): Xaa can be Ala, Cys, Asp, Glu, Phe, His, Ile, Lys, Leu, Met, Asn, Gln, Ser, Thr, Val, Trp, or Tyr
  misc_feature (8)..(8): Xaa can be Ala, Cys, Asp, Glu, Phe, His, Ile, Leu, Met, Asn, Ser, Thr, Val, Trp, or Tyr
  misc_feature (11)..(11): Xaa can be Ala, Cys, Asp, Glu, Phe, Gly, Ile, Lys, Leu, Met, Asn, Pro, Gln, Arg, Ser, Thr, Val, or Ty r
QHXKIXDXGRXKLLGAEEKEYH

SEQ ID NO: 25949 - protein, 22 aa, Artificial Sequence
  Description of Artificial Sequence: Synthetic peptide
  Seed: QHVKITDFGRAKLLGAEEKEYH (EGFR L858R)
  Core: FGRAKLLGA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QHVKITDXGRXKXLGXEEKEYH

SEQ ID NO: 25950 - protein, 23 aa, Artificial Sequence
  Description of Artificial Sequence: Synthetic peptide
  Seed: QHVKITDFGRAKLLGAEEKEYHA (EGFR L858R)
  Core: VKITDFGRA
  misc_feature (3)..(3): Xaa can be Phe, Ile, Leu, Met, Val, Trp, or Tyr
  misc_feature (6)..(6): Xaa can be Ala, Asp, Glu, Phe, His, Ile, Lys, Leu, Met, Asn, Gln, Ser, Thr, Val, Trp, or Tyr
  misc_feature (8)..(8): Xaa can be Ala, Glu, Phe, His, Ile, Leu, Trp, or Tyr
  misc_feature (11)..(11): Xaa can be Ala, Cys, Asp, Glu, Phe, Ile, Leu, Met, Asn, Ser, Thr, Val, or Tyr
QHXKIXDXGRXKLLGAEEKEYHA

SEQ ID NO: 25951 - protein, 23 aa, Artificial Sequence
  Description of Artificial Sequence: Synthetic peptide
  Seed: QHVKITDFGRAKLLGAEEKEYHA (EGFR L858R)
  Core: FGRAKLLGA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QHVKITDXGRXKXLGXEEKEYHA

SEQ ID NO: 25952 - protein, 24 aa, Artificial Sequence
  Description of Artificial Sequence: Synthetic peptide
  Seed: QHVKITDFGRAKLLGAEEKEYHAE (EGFR L858R)
  Core: FGRAKLLGA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QHVKITDXGRXKXLGXEEKEYHAE

SEQ ID NO: 25953 - protein, 25 aa, Artificial Sequence
  Description of Artificial Sequence: Synthetic peptide
  Seed: QHVKITDFGRAKLLGAEEKEYHAEG (EGFR L858R)
  Core: FGRAKLLGA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QHVKITDXGRXKXLGXEEKEYHAEG

SEQ ID NO: 25954 - protein, 25 aa, Artificial Sequence
  Description of Artificial Sequence: Synthetic peptide
  Seed: RDLAARNVLVKTPQHVKITDFGRAK (EGFR L858R)
  Core: VKITDFGRA
  misc_feature (16)..(16): Xaa can be Ala, Cys, Glu, Phe, His, Ile, Lys, Leu, Met, Gln, Arg, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
RDLAARNVLVKTPQHXKIXDXGRXK

SEQ ID NO: 25955 - protein, 19 aa, Artificial Sequence
  Description of Artificial Sequence: Synthetic peptide
  Seed: RNVLVKTPQHVKITDFGRA (EGFR L858R)
  Core: VKITDFGRA
  misc_feature (11)..(11): Xaa can be Cys, Phe, Ile, Leu, Met, Arg, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Phe, Gly, His, Ile, Leu, Met, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RNVLVKTPQHXKIXDXGRX

SEQ ID NO: 25956 - protein, 20 aa, Artificial Sequence
  Description of Artificial Sequence: Synthetic peptide
  Seed: RNVLVKTPQHVKITDFGRAK (EGFR L858R)
  Core: VKITDFGRA
  misc_feature (11)..(11): Xaa can be Ala, Cys, Glu, Phe, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RNVLVKTPQHXKIXDXGRXK

SEQ ID NO: 25957 - protein, 21 aa, Artificial Sequence
  Description of Artificial Sequence: Synthetic peptide
  Seed: RNVLVKTPQHVKITDFGRAKL (EGFR L858R)
  Core: VKITDFGRA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RNVLVKTPQHXKIXDXGRXKL

SEQ ID NO: 25958 - protein, 22 aa, Artificial Sequence
  Description of Artificial Sequence: Synthetic peptide
  Seed: RNVLVKTPQHVKITDFGRAKLL (EGFR L858R)
  Core: VKITDFGRA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RNVLVKTPQHXKIXDXGRXKLL

SEQ ID NO: 25959 - protein, 23 aa, Artificial Sequence
  Description of Artificial Sequence: Synthetic peptide
  Seed: RNVLVKTPQHVKITDFGRAKLLG (EGFR L858R)
  Core: VKITDFGRA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RNVLVKTPQHXKIXDXGRXKLLG

SEQ ID NO: 25960 - protein, 24 aa, Artificial Sequence
  Description of Artificial Sequence: Synthetic peptide
  Seed: RNVLVKTPQHVKITDFGRAKLLGA (EGFR L858R)
  Core: VKITDFGRA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RNVLVKTPQHXKIXDXGRXKLLGA

SEQ ID NO: 25961 - protein, 24 aa, Artificial Sequence
  Description of Artificial Sequence: Synthetic peptide
  Seed: RNVLVKTPQHVKITDFGRAKLLGA (EGFR L858R)
  Core: TDFGRAKLL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RNVLVKTPQHVKIXDFXRXKLXGA

SEQ ID NO: 25962 - protein, 24 aa, Artificial Sequence
  Description of Artificial Sequence: Synthetic peptide
  Seed: RNVLVKTPQHVKITDFGRAKLLGA (EGFR L858R)
  Core: FGRAKLLGA
  misc_feature (16)..(16): Xaa can be Phe, His, Met, Trp, or Tyr
  misc_feature (19)..(19): Xaa can be Ala, Gly, Ser, or Thr
  misc_feature (21)..(21): Xaa can be Ala, Ile, Leu, Pro, or Val
  misc_feature (24)..(24): Xaa can be Ala, Gly, Ser, or Val
RNVLVKTPQHVKITDXGRXKXLGX

SEQ ID NO: 25963 - protein, 25 aa, Artificial Sequence
  Description of Artificial Sequence: Synthetic peptide
  Seed: RNVLVKTPQHVKITDFGRAKLLGAE (EGFR L858R)
  Core: VKITDFGRA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RNVLVKTPQHXKIXDXGRXKLLGAE

SEQ ID NO: 25964 - protein, 25 aa, Artificial Sequence
  Description of Artificial Sequence: Synthetic peptide
  Seed: RNVLVKTPQHVKITDFGRAKLLGAE (EGFR L858R)
  Core: TDFGRAKLL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RNVLVKTPQHVKIXDFXRXKLXGAE

SEQ ID NO: 25965 - protein, 25 aa, Artificial Sequence
  Description of Artificial Sequence: Synthetic peptide
  Seed: RNVLVKTPQHVKITDFGRAKLLGAE (EGFR L858R)
  Core: FGRAKLLGA
  misc_feature (16)..(16): Xaa can be Ala, Cys, Phe, Gly, His, Ile, Leu, Met, Asn, Pro, Gln, Ser, Thr, Val, Trp, or Tyr
  misc_feature (19)..(19): Xaa can be Ala, Cys, Glu, Phe, Gly, His, Ile, Leu, Met, Asn, Gln, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
RNVLVKTPQHVKITDXGRXKXLGXE

SEQ ID NO: 25966 - protein, 14 aa, Artificial Sequence
  Description of Artificial Sequence: Synthetic peptide
  Seed: TDFGRAKLLGAEEK (EGFR L858R)
  Core: FGRAKLLGA
  misc_feature (3)..(3): Xaa can be Ala, Cys, Asp, Glu, Phe, Gly, His, Ile, Leu, Met, Asn, Pro, Gln, Ser, Thr, Val, Trp, or Ty r
  misc_feature (6)..(6): Xaa can be Ala, Glu, Phe, Gly, Ile, Leu, Met, Gln, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Leu, Met, Asn, Pro, Gln, Ser, Thr, Val, Trp, or Ty r
TDXGRXKXLGXEEK

SEQ ID NO: 25967 - protein, 15 aa, Artificial Sequence
  Description of Artificial Sequence: Synthetic peptide
  Seed: TDFGRAKLLGAEEKE (EGFR L858R)
  Core: FGRAKLLGA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TDXGRXKXLGXEEKE

SEQ ID NO: 25968 - protein, 16 aa, Artificial Sequence
  Description of Artificial Sequence: Synthetic peptide
  Seed: TDFGRAKLLGAEEKEY (EGFR L858R)
  Core: FGRAKLLGA
  misc_feature (3)..(3): Xaa can be Ala, Cys, Asp, Glu, Phe, Gly, His, Ile, Lys, Leu, Met, Asn, Pro, Gln, Ser, Thr, Val, Trp, or Tyr
  misc_feature (6)..(6): Xaa can be Ala, Cys, Glu, Phe, Gly, His, Ile, Leu, Met, Asn, Gln, Ser, Thr, Val, Trp, or Tyr
  misc_feature (8)..(8): Xaa can be Ala, Cys, Glu, Phe, Gly, His, Ile, Lys, Leu, Met, Asn, Pro, Gln, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Ser, Thr, Val, Trp, or Tyr
TDXGRXKXLGXEEKEY

SEQ ID NO: 25969 - protein, 17 aa, Artificial Sequence
  Description of Artificial Sequence: Synthetic peptide
  Seed: TDFGRAKLLGAEEKEYH (EGFR L858R)
  Core: FGRAKLLGA
  misc_feature (3)..(3): Xaa can be Ala, Cys, Asp, Glu, Phe, Gly, His, Ile, Lys, Leu, Met, Asn, Pro, Gln, Ser, Thr, Val, Trp, or Tyr
  misc_feature (6)..(6): Xaa can be Ala, Cys, Glu, Phe, Gly, Ile, Leu, Met, Asn, Gln, Ser, Thr, or Val
  misc_feature (8)..(8): Xaa can be Ala, Cys, Glu, Phe, Gly, His, Ile, Leu, Met, Asn, Pro, Gln, Arg, Ser, Thr, Val, or Trp
  misc_feature (11)..(11): Xaa can be Ala, Cys, Asp, Glu, Phe, Gly, His, Ile, Leu, Met, Asn, Pro, Gln, Arg, Ser, Thr, Val, Trp, or Tyr
TDXGRXKXLGXEEKEYH

SEQ ID NO: 25970 - protein, 18 aa, Artificial Sequence
  Description of Artificial Sequence: Synthetic peptide
  Seed: TDFGRAKLLGAEEKEYHA (EGFR L858R)
  Core: FGRAKLLGA
  misc_feature (3)..(3): Xaa can be Phe, Ile, Leu, Met, Asn, Val, Trp, or Tyr
  misc_feature (6)..(6): Xaa can be Ala, Gly, Ile, Ser, Thr, or Val
  misc_feature (8)..(8): Xaa can be Ala, Ile, Leu, Met, Pro, Ser, Thr, or Val
  misc_feature (11)..(11): Xaa can be Ala, Gly, Ile, Met, Ser, Thr, or Val
TDXGRXKXLGXEEKEYHA

SEQ ID NO: 25971 - protein, 19 aa, Artificial Sequence
  Description of Artificial Sequence: Synthetic peptide
  Seed: TDFGRAKLLGAEEKEYHAE (EGFR L858R)
  Core: FGRAKLLGA
  misc_feature (3)..(3): Xaa can be Ala, Cys, Phe, His, Ile, Leu, Met, Asn, Pro, Gln, Ser, Thr, Val, Trp, or Tyr
  misc_feature (6)..(6): Xaa can be Ala, Phe, Gly, Ile, Leu, Met, Gln, Ser, Thr, or Val
  misc_feature (8)..(8): Xaa can be Ala, Cys, Gly, His, Ile, Leu, Met, Asn, Pro, Gln, Ser, Thr, or Val
  misc_feature (11)..(11): Xaa can be Ala, Cys, Asp, Glu, Phe, Gly, His, Ile, Leu, Met, Asn, Pro, Gln, Ser, Thr, Val, Trp, or Ty r
TDXGRXKXLGXEEKEYHAE

SEQ ID NO: 25972 - protein, 20 aa, Artificial Sequence
  Description of Artificial Sequence: Synthetic peptide
  Seed: TDFGRAKLLGAEEKEYHAEG (EGFR L858R)
  Core: FGRAKLLGA
  misc_feature (3)..(3): Xaa can be Ala, Cys, Asp, Glu, Phe, Gly, His, Ile, Leu, Met, Asn, Pro, Gln, Ser, Thr, Val, Trp, or Ty r
  misc_feature (6)..(6): Xaa can be Ala, Cys, Asp, Glu, Phe, Gly, Ile, Leu, Met, Asn, Gln, Ser, Thr, or Val
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TDXGRXKXLGXEEKEYHAEG

SEQ ID NO: 25973 - protein, 21 aa, Artificial Sequence
  Description of Artificial Sequence: Synthetic peptide
  Seed: TDFGRAKLLGAEEKEYHAEGG (EGFR L858R)
  Core: FGRAKLLGA
  misc_feature (3)..(3): Xaa can be Ala, Phe, Ile, Leu, Met, Asn, Val, or Tyr
  misc_feature (6)..(6): Xaa can be Ala, Gly, Ser, Thr, or Val
  misc_feature (8)..(8): Xaa can be Ala, Ile, Leu, Met, Pro, Ser, Thr, or Val
  misc_feature (11)..(11): Xaa can be Ala, Gly, Ile, Met, Ser, Thr, or Val
TDXGRXKXLGXEEKEYHAEGG

SEQ ID NO: 25974 - protein, 22 aa, Artificial Sequence
  Description of Artificial Sequence: Synthetic peptide
  Seed: TDFGRAKLLGAEEKEYHAEGGK (EGFR L858R)
  Core: FGRAKLLGA
  misc_feature (3)..(3): Xaa can be Ala, Phe, Ile, Leu, Met, Asn, Ser, Thr, Val, Trp, or Tyr
  misc_feature (6)..(6): Xaa can be Ala, Gly, Ser, Thr, or Val
  misc_feature (8)..(8): Xaa can be Ala, Ile, Leu, Met, Pro, Ser, Thr, or Val
  misc_feature (11)..(11): Xaa can be Ala, Gly, Ile, Leu, Met, Ser, Thr, or Val
TDXGRXKXLGXEEKEYHAEGGK

SEQ ID NO: 25975 - protein, 23 aa, Artificial Sequence
  Description of Artificial Sequence: Synthetic peptide
  Seed: TDFGRAKLLGAEEKEYHAEGGKV (EGFR L858R)
  Core: FGRAKLLGA
  misc_feature (3)..(3): Xaa can be Ala, Phe, Ile, Leu, Met, Asn, Ser, Thr, Val, Trp, or Tyr
  misc_feature (6)..(6): Xaa can be Ala, Gly, Ile, Ser, Thr, or Val
  misc_feature (8)..(8): Xaa can be Ala, Ile, Leu, Met, Pro, Ser, Thr, or Val
  misc_feature (11)..(11): Xaa can be Ala, Gly, Ile, Leu, Met, Ser, Thr, or Val
TDXGRXKXLGXEEKEYHAEGGKV

SEQ ID NO: 25976 - protein, 24 aa, Artificial Sequence
  Description of Artificial Sequence: Synthetic peptide
  Seed: TDFGRAKLLGAEEKEYHAEGGKVP (EGFR L858R)
  Core: FGRAKLLGA
  misc_feature (3)..(3): Xaa can be Ala, Phe, Ile, Leu, Met, Asn, Ser, Thr, Val, Trp, or Tyr
  misc_feature (6)..(6): Xaa can be Ala, Gly, Ile, Ser, Thr, or Val
  misc_feature (8)..(8): Xaa can be Ala, Ile, Leu, Met, Pro, Ser, Thr, or Val
  misc_feature (11)..(11): Xaa can be Ala, Gly, Ile, Leu, Met, Asn, Ser, Thr, or Val
TDXGRXKXLGXEEKEYHAEGGKVP

SEQ ID NO: 25977 - protein, 25 aa, Artificial Sequence
  Description of Artificial Sequence: Synthetic peptide
  Seed: TDFGRAKLLGAEEKEYHAEGGKVPI (EGFR L858R)
  Core: FGRAKLLGA
  misc_feature (3)..(3): Xaa can be Ala, Phe, Ile, Leu, Met, Asn, Ser, Thr, Val, Trp, or Tyr
  misc_feature (6)..(6): Xaa can be Ala, Phe, Gly, Ile, Leu, Met, Gln, Ser, Thr, or Val
  misc_feature (8)..(8): Xaa can be Ala, Cys, Gly, His, Ile, Leu, Met, Asn, Pro, Gln, Ser, Thr, or Val
  misc_feature (11)..(11): Xaa can be Ala, Cys, Asp, Glu, Phe, Gly, His, Ile, Leu, Met, Asn, Pro, Gln, Ser, Thr, Val, Trp, or Ty r
TDXGRXKXLGXEEKEYHAEGGKVPI

SEQ ID NO: 25978 - protein, 14 aa, Artificial Sequence
  Description of Artificial Sequence: Synthetic peptide
  Seed: TPQHVKITDFGRAK (EGFR L858R)
  Core: VKITDFGRA
  misc_feature (5)..(5): Xaa can be Ala, Cys, Phe, His, Ile, Leu, Met, Arg, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Phe, Ile, Leu, Met, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPQHXKIXDXGRXK

SEQ ID NO: 25979 - protein, 15 aa, Artificial Sequence
  Description of Artificial Sequence: Synthetic peptide
  Seed: TPQHVKITDFGRAKL (EGFR L858R)
  Core: VKITDFGRA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPQHXKIXDXGRXKL

SEQ ID NO: 25980 - protein, 16 aa, Artificial Sequence
  Description of Artificial Sequence: Synthetic peptide
  Seed: TPQHVKITDFGRAKLL (EGFR L858R)
  Core: VKITDFGRA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPQHXKIXDXGRXKLL

SEQ ID NO: 25981 - protein, 17 aa, Artificial Sequence
  Description of Artificial Sequence: Synthetic peptide
  Seed: TPQHVKITDFGRAKLLG (EGFR L858R)
  Core: VKITDFGRA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPQHXKIXDXGRXKLLG

SEQ ID NO: 25982 - protein, 18 aa, Artificial Sequence
  Description of Artificial Sequence: Synthetic peptide
  Seed: TPQHVKITDFGRAKLLGA (EGFR L858R)
  Core: VKITDFGRA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPQHXKIXDXGRXKLLGA

SEQ ID NO: 25983 - protein, 19 aa, Artificial Sequence
  Description of Artificial Sequence: Synthetic peptide
  Seed: TPQHVKITDFGRAKLLGAE (EGFR L858R)
  Core: VKITDFGRA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPQHXKIXDXGRXKLLGAE

SEQ ID NO: 25984 - protein, 19 aa, Artificial Sequence
  Description of Artificial Sequence: Synthetic peptide
  Seed: TPQHVKITDFGRAKLLGAE (EGFR L858R)
  Core: TDFGRAKLL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPQHVKIXDFXRXKLXGAE

SEQ ID NO: 25985 - protein, 19 aa, Artificial Sequence
  Description of Artificial Sequence: Synthetic peptide
  Seed: TPQHVKITDFGRAKLLGAE (EGFR L858R)
  Core: FGRAKLLGA
  misc_feature (10)..(10): Xaa can be Ala, Cys, Glu, Phe, Gly, His, Ile, Leu, Met, Asn, Pro, Gln, Ser, Thr, Val, Trp, or Tyr
  misc_feature (13)..(13): Xaa can be Ala, Glu, Phe, Gly, Ile, Leu, Met, Gln, Ser, Thr, Val, or Trp
  misc_feature (15)..(15): Xaa can be Ala, Cys, Phe, Gly, His, Ile, Lys, Leu, Met, Asn, Pro, Gln, Arg, Ser, Thr, Val, Trp, or Ty r
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPQHVKITDXGRXKXLGXE

SEQ ID NO: 25986 - protein, 20 aa, Artificial Sequence
  Description of Artificial Sequence: Synthetic peptide
  Seed: TPQHVKITDFGRAKLLGAEE (EGFR L858R)
  Core: VKITDFGRA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPQHXKIXDXGRXKLLGAEE

SEQ ID NO: 25987 - protein, 20 aa, Artificial Sequence
  Description of Artificial Sequence: Synthetic peptide
  Seed: TPQHVKITDFGRAKLLGAEE (EGFR L858R)
  Core: TDFGRAKLL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPQHVKIXDFXRXKLXGAEE

SEQ ID NO: 25988 - protein, 20 aa, Artificial Sequence
  Description of Artificial Sequence: Synthetic peptide
  Seed: TPQHVKITDFGRAKLLGAEE (EGFR L858R)
  Core: FGRAKLLGA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Leu, Met, Asn, Pro, Gln, Ser, Thr, Val, Trp, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPQHVKITDXGRXKXLGXEE

SEQ ID NO: 25989 - protein, 21 aa, Artificial Sequence
  Description of Artificial Sequence: Synthetic peptide
  Seed: TPQHVKITDFGRAKLLGAEEK (EGFR L858R)
  Core: VKITDFGRA
  misc_feature (5)..(5): Xaa can be Ala, Cys, Asp, Glu, Phe, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPQHXKIXDXGRXKLLGAEEK

SEQ ID NO: 25990 - protein, 21 aa, Artificial Sequence
  Description of Artificial Sequence: Synthetic peptide
  Seed: TPQHVKITDFGRAKLLGAEEK (EGFR L858R)
  Core: FGRAKLLGA
  misc_feature (10)..(10): Xaa can be Ala, Cys, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Glu, Phe, Gly, His, Ile, Lys, Leu, Met, Asn, Gln, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPQHVKITDXGRXKXLGXEEK

SEQ ID NO: 25991 - protein, 22 aa, Artificial Sequence
  Description of Artificial Sequence: Synthetic peptide
  Seed: TPQHVKITDFGRAKLLGAEEKE (EGFR L858R)
  Core: VKITDFGRA
  misc_feature (5)..(5): Xaa can be Ala, Cys, Asp, Glu, Phe, Gly, His, Ile, Lys, Leu, Met, Asn, Pro, Gln, Arg, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPQHXKIXDXGRXKLLGAEEKE

SEQ ID NO: 25992 - protein, 22 aa, Artificial Sequence
  Description of Artificial Sequence: Synthetic peptide
  Seed: TPQHVKITDFGRAKLLGAEEKE (EGFR L858R)
  Core: FGRAKLLGA
  misc_feature (10)..(10): Xaa can be Ala, Cys, Asp, Glu, Phe, Gly, His, Ile, Leu, Met, Asn, Pro, Gln, Arg, Ser, Thr, Val, Trp, or Tyr
  misc_feature (13)..(13): Xaa can be Ala, Cys, Glu, Phe, Gly, His, Ile, Lys, Leu, Met, Asn, Gln, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPQHVKITDXGRXKXLGXEEKE

SEQ ID NO: 25993 - protein, 23 aa, Artificial Sequence
  Description of Artificial Sequence: Synthetic peptide
  Seed: TPQHVKITDFGRAKLLGAEEKEY (EGFR L858R)
  Core: VKITDFGRA
  misc_feature (5)..(5): Xaa can be Ala, Cys, Asp, Glu, Phe, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPQHXKIXDXGRXKLLGAEEKEY

SEQ ID NO: 25994 - protein, 23 aa, Artificial Sequence
  Description of Artificial Sequence: Synthetic peptide
  Seed: TPQHVKITDFGRAKLLGAEEKEY (EGFR L858R)
  Core: FGRAKLLGA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Gln, Ser, Thr, Val, Trp, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPQHVKITDXGRXKXLGXEEKEY

SEQ ID NO: 25995 - protein, 24 aa, Artificial Sequence
  Description of Artificial Sequence: Synthetic peptide
  Seed: TPQHVKITDFGRAKLLGAEEKEYH (EGFR L858R)
  Core: VKITDFGRA
  misc_feature (5)..(5): Xaa can be Ala, Cys, Asp, Glu, Phe, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPQHXKIXDXGRXKLLGAEEKEYH

SEQ ID NO: 25996 - protein, 24 aa, Artificial Sequence
  Description of Artificial Sequence: Synthetic peptide
  Seed: TPQHVKITDFGRAKLLGAEEKEYH (EGFR L858R)
  Core: FGRAKLLGA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Gln, Ser, Thr, Val, Trp, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPQHVKITDXGRXKXLGXEEKEYH

SEQ ID NO: 25997 - protein, 25 aa, Artificial Sequence
  Description of Artificial Sequence: Synthetic peptide
  Seed: TPQHVKITDFGRAKLLGAEEKEYHA (EGFR L858R)
  Core: VKITDFGRA
  misc_feature (5)..(5): Xaa can be Ala, Cys, Asp, Glu, Phe, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPQHXKIXDXGRXKLLGAEEKEYHA

SEQ ID NO: 25998 - protein, 25 aa, Artificial Sequence
  Description of Artificial Sequence: Synthetic peptide
  Seed: TPQHVKITDFGRAKLLGAEEKEYHA (EGFR L858R)
  Core: FGRAKLLGA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPQHVKITDXGRXKXLGXEEKEYHA

SEQ ID NO: 25999 - protein, 14 aa, Artificial Sequence
  Description of Artificial Sequence: Synthetic peptide
  Seed: VKITDFGRAKLLGA (EGFR L858R)
  Core: TDFGRAKLL
  misc_feature (4)..(4): Xaa can be Ala, Cys, Glu, Phe, His, Ile, Leu, Met, Asn, Pro, Gln, Ser, Thr, Val, Trp, or Tyr
  misc_feature (7)..(7): Xaa can be Ala, Cys, Asp, Gly, Ile, Leu, Ser, Thr, Val, or Trp
  misc_feature (9)..(9): Xaa can be Ala, Cys, Gly, Ile, Leu, Met, Pro, Ser, Thr, or Val
  misc_feature (12)..(12): Xaa can be Ala, Cys, Asp, Glu, Phe, Gly, His, Ile, Leu, Met, Asn, Pro, Gln, Ser, Thr, Val, Trp, or Ty r
VKIXDFXRXKLXGA

SEQ ID NO: 26000 - protein, 14 aa, Artificial Sequence
  Description of Artificial Sequence: Synthetic peptide
  Seed: VKITDFGRAKLLGA (EGFR L858R)
  Core: FGRAKLLGA
  misc_feature (6)..(6): Xaa can be Ala, Cys, Phe, Gly, His, Ile, Leu, Met, Asn, Pro, Gln, Ser, Thr, Val, Trp, or Tyr
  misc_feature (9)..(9): Xaa can be Ala, Gly, Ile, Ser, Thr, or Val
  misc_feature (11)..(11): Xaa can be Ala, Cys, Gly, Ile, Leu, Met, Asn, Pro, Ser, Thr, or Val
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VKITDXGRXKXLGX

SEQ ID NO: 26001 - protein, 15 aa, Artificial Sequence
  Description of Artificial Sequence: Synthetic peptide
  Seed: VKITDFGRAKLLGAE (EGFR L858R)
  Core: TDFGRAKLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKIXDFXRXKLXGAE

SEQ ID NO: 26002 - protein, 15 aa, Artificial Sequence
  Description of Artificial Sequence: Synthetic peptide
  Seed: VKITDFGRAKLLGAE (EGFR L858R)
  Core: FGRAKLLGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VKITDXGRXKXLGXE

SEQ ID NO: 26003 - protein, 16 aa, Artificial Sequence
  Description of Artificial Sequence: Synthetic peptide
  Seed: VKITDFGRAKLLGAEE (EGFR L858R)
  Core: FGRAKLLGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VKITDXGRXKXLGXEE

SEQ ID NO: 26004 - protein, 17 aa, Artificial Sequence
  Description of Artificial Sequence: Synthetic peptide
  Seed: VKITDFGRAKLLGAEEK (EGFR L858R)
  Core: FGRAKLLGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VKITDXGRXKXLGXEEK

SEQ ID NO: 26005 - protein, 18 aa, Artificial Sequence
  Description of Artificial Sequence: Synthetic peptide
  Seed: VKITDFGRAKLLGAEEKE (EGFR L858R)
  Core: FGRAKLLGA
  misc_feature (6)..(6): Xaa can be Ala, Cys, Glu, Phe, Gly, His, Ile, Leu, Met, Asn, Pro, Gln, Ser, Thr, Val, Trp, or Tyr
  misc_feature (9)..(9): Xaa can be Ala, Gly, Ile, Met, Ser, Thr, or Val
  misc_feature (11)..(11): Xaa can be Ala, Gly, Ile, Leu, Met, Asn, Pro, Ser, Thr, or Val
  misc_feature (14)..(14): Xaa can be Ala, Cys, Asp, Glu, Phe, Gly, His, Ile, Leu, Met, Asn, Pro, Gln, Ser, Thr, Val, Trp, or Ty r
VKITDXGRXKXLGXEEKE

SEQ ID NO: 26006 - protein, 19 aa, Artificial Sequence
  Description of Artificial Sequence: Synthetic peptide
  Seed: VKITDFGRAKLLGAEEKEY (EGFR L858R)
  Core: FGRAKLLGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VKITDXGRXKXLGXEEKEY

SEQ ID NO: 26007 - protein, 20 aa, Artificial Sequence
  Description of Artificial Sequence: Synthetic peptide
  Seed: VKITDFGRAKLLGAEEKEYH (EGFR L858R)
  Core: FGRAKLLGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VKITDXGRXKXLGXEEKEYH

SEQ ID NO: 26008 - protein, 21 aa, Artificial Sequence
  Description of Artificial Sequence: Synthetic peptide
  Seed: VKITDFGRAKLLGAEEKEYHA (EGFR L858R)
  Core: FGRAKLLGA
  misc_feature (6)..(6): Xaa can be Ala, Cys, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VKITDXGRXKXLGXEEKEYHA

SEQ ID NO: 26009 - protein, 22 aa, Artificial Sequence
  Description of Artificial Sequence: Synthetic peptide
  Seed: VKITDFGRAKLLGAEEKEYHAE (EGFR L858R)
  Core: FGRAKLLGA
  misc_feature (6)..(6): Xaa can be Ala, Cys, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VKITDXGRXKXLGXEEKEYHAE

SEQ ID NO: 26010 - protein, 23 aa, Artificial Sequence
  Description of Artificial Sequence: Synthetic peptide
  Seed: VKITDFGRAKLLGAEEKEYHAEG (EGFR L858R)
  Core: FGRAKLLGA
  misc_feature (6)..(6): Xaa can be Ala, Cys, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VKITDXGRXKXLGXEEKEYHAEG

SEQ ID NO: 26011 - protein, 24 aa, Artificial Sequence
  Description of Artificial Sequence: Synthetic peptide
  Seed: VKITDFGRAKLLGAEEKEYHAEGG (EGFR L858R)
  Core: FGRAKLLGA
  misc_feature (6)..(6): Xaa can be Ala, Cys, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VKITDXGRXKXLGXEEKEYHAEGG

SEQ ID NO: 26012 - protein, 25 aa, Artificial Sequence
  Description of Artificial Sequence: Synthetic peptide
  Seed: VKITDFGRAKLLGAEEKEYHAEGGK (EGFR L858R)
  Core: FGRAKLLGA
  misc_feature (6)..(6): Xaa can be Ala, Cys, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VKITDXGRXKXLGXEEKEYHAEGGK

SEQ ID NO: 26013 - protein, 15 aa, Artificial Sequence
  Description of Artificial Sequence: Synthetic peptide
  Seed: VKTPQHVKITDFGRA (EGFR L858R)
  Core: VKITDFGRA
  misc_feature (7)..(7): Xaa can be Ala, Cys, Phe, His, Ile, Leu, Met, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHXKIXDXGRX

SEQ ID NO: 26014 - protein, 16 aa, Artificial Sequence
  Description of Artificial Sequence: Synthetic peptide
  Seed: VKTPQHVKITDFGRAK (EGFR L858R)
  Core: VKITDFGRA
  misc_feature (7)..(7): Xaa can be Ala, Cys, Glu, Phe, His, Ile, Lys, Leu, Met, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Glu, Phe, Gly, His, Ile, Leu, Met, Asn, Pro, Gln, Arg, Ser, Thr, Val, Trp, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHXKIXDXGRXK

SEQ ID NO: 26015 - protein, 17 aa, Artificial Sequence
  Description of Artificial Sequence: Synthetic peptide
  Seed: VKTPQHVKITDFGRAKL (EGFR L858R)
  Core: VKITDFGRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHXKIXDXGRXKL

SEQ ID NO: 26016 - protein, 18 aa, Artificial Sequence
  Description of Artificial Sequence: Synthetic peptide
  Seed: VKTPQHVKITDFGRAKLL (EGFR L858R)
  Core: VKITDFGRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHXKIXDXGRXKLL

SEQ ID NO: 26017 - protein, 19 aa, Artificial Sequence
  Description of Artificial Sequence: Synthetic peptide
  Seed: VKTPQHVKITDFGRAKLLG (EGFR L858R)
  Core: VKITDFGRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHXKIXDXGRXKLLG

SEQ ID NO: 26018 - protein, 20 aa, Artificial Sequence
  Description of Artificial Sequence: Synthetic peptide
  Seed: VKTPQHVKITDFGRAKLLGA (EGFR L858R)
  Core: VKITDFGRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHXKIXDXGRXKLLGA

SEQ ID NO: 26019 - protein, 20 aa, Artificial Sequence
  Description of Artificial Sequence: Synthetic peptide
  Seed: VKTPQHVKITDFGRAKLLGA (EGFR L858R)
  Core: TDFGRAKLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHVKIXDFXRXKLXGA

SEQ ID NO: 26020 - protein, 20 aa, Artificial Sequence
  Description of Artificial Sequence: Synthetic peptide
  Seed: VKTPQHVKITDFGRAKLLGA (EGFR L858R)
  Core: FGRAKLLGA
  misc_feature (12)..(12): Xaa can be Glu, Phe, His, Ile, Leu, Met, Asn, Pro, Gln, Thr, Val, Trp, or Tyr
  misc_feature (15)..(15): Xaa can be Ala, Gly, Ile, Ser, Thr, or Val
  misc_feature (17)..(17): Xaa can be Ala, Cys, Gly, Ile, Leu, Met, Pro, Ser, Thr, or Val
  misc_feature (20)..(20): Xaa can be Ala, Cys, Asp, Glu, Phe, Gly, His, Ile, Leu, Met, Asn, Gln, Ser, Thr, Val, Trp, or Tyr
VKTPQHVKITDXGRXKXLGX

SEQ ID NO: 26021 - protein, 21 aa, Artificial Sequence
  Description of Artificial Sequence: Synthetic peptide
  Seed: VKTPQHVKITDFGRAKLLGAE (EGFR L858R)
  Core: VKITDFGRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHXKIXDXGRXKLLGAE

SEQ ID NO: 26022 - protein, 21 aa, Artificial Sequence
  Description of Artificial Sequence: Synthetic peptide
  Seed: VKTPQHVKITDFGRAKLLGAE (EGFR L858R)
  Core: TDFGRAKLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHVKIXDFXRXKLXGAE

SEQ ID NO: 26023 - protein, 21 aa, Artificial Sequence
  Description of Artificial Sequence: Synthetic peptide
  Seed: VKTPQHVKITDFGRAKLLGAE (EGFR L858R)
  Core: FGRAKLLGA
  misc_feature (12)..(12): Xaa can be Ala, Cys, Phe, His, Ile, Leu, Met, Asn, Pro, Gln, Ser, Thr, Val, Trp, or Tyr
  misc_feature (15)..(15): Xaa can be Ala, Glu, Phe, Gly, Ile, Leu, Met, Gln, Ser, Thr, Val, or Trp
  misc_feature (17)..(17): Xaa can be Ala, Cys, Glu, Phe, Gly, His, Ile, Lys, Leu, Met, Asn, Pro, Gln, Arg, Ser, Thr, Val, or Ty r
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHVKITDXGRXKXLGXE

SEQ ID NO: 26024 - protein, 22 aa, Artificial Sequence
  Description of Artificial Sequence: Synthetic peptide
  Seed: VKTPQHVKITDFGRAKLLGAEE (EGFR L858R)
  Core: VKITDFGRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHXKIXDXGRXKLLGAEE

SEQ ID NO: 26025 - protein, 22 aa, Artificial Sequence
  Description of Artificial Sequence: Synthetic peptide
  Seed: VKTPQHVKITDFGRAKLLGAEE (EGFR L858R)
  Core: TDFGRAKLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHVKIXDFXRXKLXGAEE

SEQ ID NO: 26026 - protein, 22 aa, Artificial Sequence
  Description of Artificial Sequence: Synthetic peptide
  Seed: VKTPQHVKITDFGRAKLLGAEE (EGFR L858R)
  Core: FGRAKLLGA
  misc_feature (12)..(12): Xaa can be Ala, Cys, Glu, Phe, Gly, His, Ile, Leu, Met, Asn, Pro, Gln, Ser, Thr, Val, Trp, or Tyr
  misc_feature (15)..(15): Xaa can be Ala, Glu, Phe, Gly, His, Ile, Leu, Met, Asn, Gln, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHVKITDXGRXKXLGXEE

SEQ ID NO: 26027 - protein, 23 aa, Artificial Sequence
  Description of Artificial Sequence: Synthetic peptide
  Seed: VKTPQHVKITDFGRAKLLGAEEK (EGFR L858R)
  Core: VKITDFGRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHXKIXDXGRXKLLGAEEK

SEQ ID NO: 26028 - protein, 23 aa, Artificial Sequence
  Description of Artificial Sequence: Synthetic peptide
  Seed: VKTPQHVKITDFGRAKLLGAEEK (EGFR L858R)
  Core: FGRAKLLGA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Gln, Ser, Thr, Val, Trp, or Ty r
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHVKITDXGRXKXLGXEEK

SEQ ID NO: 26029 - protein, 24 aa, Artificial Sequence
  Description of Artificial Sequence: Synthetic peptide
  Seed: VKTPQHVKITDFGRAKLLGAEEKE (EGFR L858R)
  Core: VKITDFGRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHXKIXDXGRXKLLGAEEKE

SEQ ID NO: 26030 - protein, 24 aa, Artificial Sequence
  Description of Artificial Sequence: Synthetic peptide
  Seed: VKTPQHVKITDFGRAKLLGAEEKE (EGFR L858R)
  Core: FGRAKLLGA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Gln, Ser, Thr, Val, Trp, or Ty r
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHVKITDXGRXKXLGXEEKE

SEQ ID NO: 26031 - protein, 25 aa, Artificial Sequence
  Description of Artificial Sequence: Synthetic peptide
  Seed: VKTPQHVKITDFGRAKLLGAEEKEY (EGFR L858R)
  Core: VKITDFGRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHXKIXDXGRXKLLGAEEKEY

SEQ ID NO: 26032 - protein, 25 aa, Artificial Sequence
  Description of Artificial Sequence: Synthetic peptide
  Seed: VKTPQHVKITDFGRAKLLGAEEKEY (EGFR L858R)
  Core: FGRAKLLGA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VKTPQHVKITDXGRXKXLGXEEKEY

SEQ ID NO: 26033 - protein, 17 aa, Artificial Sequence
  Description of Artificial Sequence: Synthetic peptide
  Seed: VLVKTPQHVKITDFGRA (EGFR L858R)
  Core: VKITDFGRA
  misc_feature (9)..(9): Xaa can be Cys, Phe, Ile, Leu, Met, Arg, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Phe, Gly, His, Ile, Leu, Met, Ser, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLVKTPQHXKIXDXGRX

SEQ ID NO: 26034 - protein, 19 aa, Artificial Sequence
  Description of Artificial Sequence: Synthetic peptide
  Seed: VLVKTPQHVKITDFGRAKL (EGFR L858R)
  Core: VKITDFGRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLVKTPQHXKIXDXGRXKL

SEQ ID NO: 26035 - protein, 20 aa, Artificial Sequence
  Description of Artificial Sequence: Synthetic peptide
  Seed: VLVKTPQHVKITDFGRAKLL (EGFR L858R)
  Core: VKITDFGRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLVKTPQHXKIXDXGRXKLL

SEQ ID NO: 26036 - protein, 21 aa, Artificial Sequence
  Description of Artificial Sequence: Synthetic peptide
  Seed: VLVKTPQHVKITDFGRAKLLG (EGFR L858R)
  Core: VKITDFGRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLVKTPQHXKIXDXGRXKLLG

SEQ ID NO: 26037 - protein, 22 aa, Artificial Sequence
  Description of Artificial Sequence: Synthetic peptide
  Seed: VLVKTPQHVKITDFGRAKLLGA (EGFR L858R)
  Core: VKITDFGRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLVKTPQHXKIXDXGRXKLLGA

SEQ ID NO: 26038 - protein, 22 aa, Artificial Sequence
  Description of Artificial Sequence: Synthetic peptide
  Seed: VLVKTPQHVKITDFGRAKLLGA (EGFR L858R)
  Core: TDFGRAKLL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLVKTPQHVKIXDFXRXKLXGA

SEQ ID NO: 26039 - protein, 23 aa, Artificial Sequence
  Description of Artificial Sequence: Synthetic peptide
  Seed: VLVKTPQHVKITDFGRAKLLGAE (EGFR L858R)
  Core: VKITDFGRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLVKTPQHXKIXDXGRXKLLGAE

SEQ ID NO: 26040 - protein, 23 aa, Artificial Sequence
  Description of Artificial Sequence: Synthetic peptide
  Seed: VLVKTPQHVKITDFGRAKLLGAE (EGFR L858R)
  Core: TDFGRAKLL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLVKTPQHVKIXDFXRXKLXGAE

SEQ ID NO: 26041 - protein, 23 aa, Artificial Sequence
  Description of Artificial Sequence: Synthetic peptide
  Seed: VLVKTPQHVKITDFGRAKLLGAE (EGFR L858R)
  Core: FGRAKLLGA
  misc_feature (14)..(14): Xaa can be Ala, Cys, Phe, Gly, His, Ile, Leu, Met, Asn, Pro, Gln, Ser, Thr, Val, Trp, or Tyr
  misc_feature (17)..(17): Xaa can be Ala, Glu, Phe, Gly, Ile, Leu, Met, Gln, Ser, Thr, Val, Trp, or Tyr
  misc_feature (19)..(19): Xaa can be Ala, Cys, Glu, Phe, Gly, His, Ile, Lys, Leu, Met, Asn, Pro, Gln, Arg, Ser, Thr, Val, or Ty r
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VLVKTPQHVKITDXGRXKXLGXE

SEQ ID NO: 26042 - protein, 24 aa, Artificial Sequence
  Description of Artificial Sequence: Synthetic peptide
  Seed: VLVKTPQHVKITDFGRAKLLGAEE (EGFR L858R)
  Core: VKITDFGRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLVKTPQHXKIXDXGRXKLLGAEE

SEQ ID NO: 26043 - protein, 24 aa, Artificial Sequence
  Description of Artificial Sequence: Synthetic peptide
  Seed: VLVKTPQHVKITDFGRAKLLGAEE (EGFR L858R)
  Core: TDFGRAKLL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLVKTPQHVKIXDFXRXKLXGAEE

SEQ ID NO: 26044 - protein, 24 aa, Artificial Sequence
  Description of Artificial Sequence: Synthetic peptide
  Seed: VLVKTPQHVKITDFGRAKLLGAEE (EGFR L858R)
  Core: FGRAKLLGA
  misc_feature (14)..(14): Xaa can be Ala, Cys, Glu, Phe, Gly, His, Ile, Leu, Met, Asn, Pro, Gln, Ser, Thr, Val, Trp, or Tyr
  misc_feature (17)..(17): Xaa can be Ala, Cys, Glu, Phe, Gly, His, Ile, Leu, Met, Asn, Gln, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VLVKTPQHVKITDXGRXKXLGXEE

SEQ ID NO: 26045 - protein, 25 aa, Artificial Sequence
  Description of Artificial Sequence: Synthetic peptide
  Seed: VLVKTPQHVKITDFGRAKLLGAEEK (EGFR L858R)
  Core: VKITDFGRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLVKTPQHXKIXDXGRXKLLGAEEK

SEQ ID NO: 26046 - protein, 25 aa, Artificial Sequence
  Description of Artificial Sequence: Synthetic peptide
  Seed: VLVKTPQHVKITDFGRAKLLGAEEK (EGFR L858R)
  Core: FGRAKLLGA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Gln, Ser, Thr, Val, Trp, or Ty r
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VLVKTPQHVKITDXGRXKXLGXEEK

SEQ ID NO: 26047 - protein, 24 aa, Artificial Sequence
  Description of Artificial Sequence: Synthetic peptide
  Seed: EGIPFRRPSTYGIPRLERILHAKE (GTF2I L424H)
  Core: PRLERILHA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EGIPFRRPSTYGIXRLXRXLHXKE

SEQ ID NO: 26048 - protein, 25 aa, Artificial Sequence
  Description of Artificial Sequence: Synthetic peptide
  Seed: EGIPFRRPSTYGIPRLERILHAKER (GTF2I L424H)
  Core: PRLERILHA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EGIPFRRPSTYGIXRLXRXLHXKER

SEQ ID NO: 26049 - protein, 13 aa, Artificial Sequence
  Description of Artificial Sequence: Synthetic peptide
  Seed: ERILHAKERIRFV (GTF2I L424H)
  Core: ILHAKERIR
  misc_feature (3)..(3): Xaa can be Phe, Ile, Leu, Met, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Gly, His, Ile, Lys, Leu, Met, Asn, Pro, Gln, Arg, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ERXLHXKXRIXFV

SEQ ID NO: 26050 - protein, 13 aa, Artificial Sequence
  Description of Artificial Sequence: Synthetic peptide
  Seed: ERILHAKERIRFV (GTF2I L424H)
  Core: LHAKERIRF
  misc_feature (4)..(4): Xaa can be Ala, Cys, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ERIXHAXEXIRXV

SEQ ID NO: 26051 - protein, 14 aa, Artificial Sequence
  Description of Artificial Sequence: Synthetic peptide
  Seed: ERILHAKERIRFVI (GTF2I L424H)
  Core: ILHAKERIR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ERXLHXKXRIXFVI

SEQ ID NO: 26052 - protein, 14 aa, Artificial Sequence
  Description of Artificial Sequence: Synthetic peptide
  Seed: ERILHAKERIRFVI (GTF2I L424H)
  Core: LHAKERIRF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ERIXHAXEXIRXVI

SEQ ID NO: 26053 - protein, 15 aa, Artificial Sequence
  Description of Artificial Sequence: Synthetic peptide
  Seed: ERILHAKERIRFVIK (GTF2I L424H)
  Core: ILHAKERIR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ERXLHXKXRIXFVIK

SEQ ID NO: 26054 - protein, 15 aa, Artificial Sequence
  Description of Artificial Sequence: Synthetic peptide
  Seed: ERILHAKERIRFVIK (GTF2I L424H)
  Core: LHAKERIRF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ERIXHAXEXIRXVIK

SEQ ID NO: 26055 - protein, 16 aa, Artificial Sequence
  Description of Artificial Sequence: Synthetic peptide
  Seed: ERILHAKERIRFVIKK (GTF2I L424H)
  Core: ILHAKERIR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ERXLHXKXRIXFVIKK

SEQ ID NO: 26056 - protein, 16 aa, Artificial Sequence
  Description of Artificial Sequence: Synthetic peptide
  Seed: ERILHAKERIRFVIKK (GTF2I L424H)
  Core: LHAKERIRF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ERIXHAXEXIRXVIKK

SEQ ID NO: 26057 - protein, 17 aa, Artificial Sequence
  Description of Artificial Sequence: Synthetic peptide
  Seed: ERILHAKERIRFVIKKH (GTF2I L424H)
  Core: ILHAKERIR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ERXLHXKXRIXFVIKKH

SEQ ID NO: 26058 - protein, 17 aa, Artificial Sequence
  Description of Artificial Sequence: Synthetic peptide
  Seed: ERILHAKERIRFVIKKH (GTF2I L424H)
  Core: LHAKERIRF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ERIXHAXEXIRXVIKKH

SEQ ID NO: 26059 - protein, 18 aa, Artificial Sequence
  Description of Artificial Sequence: Synthetic peptide
  Seed: ERILHAKERIRFVIKKHE (GTF2I L424H)
  Core: ILHAKERIR
  misc_feature (3)..(3): Xaa can be Phe, Ile, Leu, Met, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Gly, His, Lys, Asn, Pro, Gln, Arg, Ser, Thr, or Val
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
ERXLHXKXRIXFVIKKHE

SEQ ID NO: 26060 - protein, 18 aa, Artificial Sequence
  Description of Artificial Sequence: Synthetic peptide
  Seed: ERILHAKERIRFVIKKHE (GTF2I L424H)
  Core: LHAKERIRF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ERIXHAXEXIRXVIKKHE

SEQ ID NO: 26061 - protein, 19 aa, Artificial Sequence
  Description of Artificial Sequence: Synthetic peptide
  Seed: ERILHAKERIRFVIKKHEL (GTF2I L424H)
  Core: LHAKERIRF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ERIXHAXEXIRXVIKKHEL

SEQ ID NO: 26062 - protein, 20 aa, Artificial Sequence
  Description of Artificial Sequence: Synthetic peptide
  Seed: ERILHAKERIRFVIKKHELL (GTF2I L424H)
  Core: LHAKERIRF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ERIXHAXEXIRXVIKKHELL

SEQ ID NO: 26063 - protein, 20 aa, Artificial Sequence
  Description of Artificial Sequence: Synthetic peptide
  Seed: FRRPSTYGIPRLERILHAKE (GTF2I L424H)
  Core: PRLERILHA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
FRRPSTYGIXRLXRXLHXKE

SEQ ID NO: 26064 - protein, 21 aa, Artificial Sequence
  Description of Artificial Sequence: Synthetic peptide
  Seed: FRRPSTYGIPRLERILHAKER (GTF2I L424H)
  Core: PRLERILHA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
FRRPSTYGIXRLXRXLHXKER

SEQ ID NO: 26065 - protein, 22 aa, Artificial Sequence
  Description of Artificial Sequence: Synthetic peptide
  Seed: FRRPSTYGIPRLERILHAKERI (GTF2I L424H)
  Core: PRLERILHA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
FRRPSTYGIXRLXRXLHXKERI

SEQ ID NO: 26066 - protein, 23 aa, Artificial Sequence
  Description of Artificial Sequence: Synthetic peptide
  Seed: FRRPSTYGIPRLERILHAKERIR (GTF2I L424H)
  Core: PRLERILHA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
FRRPSTYGIXRLXRXLHXKERIR

SEQ ID NO: 26067 - protein, 24 aa, Artificial Sequence
  Description of Artificial Sequence: Synthetic peptide
  Seed: FRRPSTYGIPRLERILHAKERIRF (GTF2I L424H)
  Core: PRLERILHA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
FRRPSTYGIXRLXRXLHXKERIRF

SEQ ID NO: 26068 - protein, 24 aa, Artificial Sequence
  Description of Artificial Sequence: Synthetic peptide
  Seed: FRRPSTYGIPRLERILHAKERIRF (GTF2I L424H)
  Core: ERILHAKER
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
FRRPSTYGIPRLXRIXHXKEXIRF

SEQ ID NO: 26069 - protein, 24 aa, Artificial Sequence
  Description of Artificial Sequence: Synthetic peptide
  Seed: FRRPSTYGIPRLERILHAKERIRF (GTF2I L424H)
  Core: ILHAKERIR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
FRRPSTYGIPRLERXLHXKXRIXF

SEQ ID NO: 26070 - protein, 25 aa, Artificial Sequence
  Description of Artificial Sequence: Synthetic peptide
  Seed: FRRPSTYGIPRLERILHAKERIRFV (GTF2I L424H)
  Core: PRLERILHA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
FRRPSTYGIXRLXRXLHXKERIRFV

SEQ ID NO: 26071 - protein, 25 aa, Artificial Sequence
  Description of Artificial Sequence: Synthetic peptide
  Seed: FRRPSTYGIPRLERILHAKERIRFV (GTF2I L424H)
  Core: ERILHAKER
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
FRRPSTYGIPRLXRIXHXKEXIRFV

SEQ ID NO: 26072 - protein, 25 aa, Artificial Sequence
  Description of Artificial Sequence: Synthetic peptide
  Seed: FRRPSTYGIPRLERILHAKERIRFV (GTF2I L424H)
  Core: ILHAKERIR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
FRRPSTYGIPRLERXLHXKXRIXFV

SEQ ID NO: 26073 - protein, 25 aa, Artificial Sequence
  Description of Artificial Sequence: Synthetic peptide
  Seed: FRRPSTYGIPRLERILHAKERIRFV (GTF2I L424H)
  Core: LHAKERIRF
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
FRRPSTYGIPRLERIXHAXEXIRXV

SEQ ID NO: 26074 - protein, 23 aa, Artificial Sequence
  Description of Artificial Sequence: Synthetic peptide
  Seed: GIPFRRPSTYGIPRLERILHAKE (GTF2I L424H)
  Core: PRLERILHA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GIPFRRPSTYGIXRLXRXLHXKE

SEQ ID NO: 26075 - protein, 24 aa, Artificial Sequence
  Description of Artificial Sequence: Synthetic peptide
  Seed: GIPFRRPSTYGIPRLERILHAKER (GTF2I L424H)
  Core: PRLERILHA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GIPFRRPSTYGIXRLXRXLHXKER

SEQ ID NO: 26076 - protein, 25 aa, Artificial Sequence
  Description of Artificial Sequence: Synthetic peptide
  Seed: GIPFRRPSTYGIPRLERILHAKERI (GTF2I L424H)
  Core: PRLERILHA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GIPFRRPSTYGIXRLXRXLHXKERI

SEQ ID NO: 26077 - protein, 14 aa, Artificial Sequence
  Description of Artificial Sequence: Synthetic peptide
  Seed: GIPRLERILHAKER (GTF2I L424H)
  Core: PRLERILHA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXRLXRXLHXKER

SEQ ID NO: 26078 - protein, 15 aa, Artificial Sequence
  Description of Artificial Sequence: Synthetic peptide
  Seed: GIPRLERILHAKERI (GTF2I L424H)
  Core: PRLERILHA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXRLXRXLHXKERI

SEQ ID NO: 26079 - protein, 16 aa, Artificial Sequence
  Description of Artificial Sequence: Synthetic peptide
  Seed: GIPRLERILHAKERIR (GTF2I L424H)
  Core: ERILHAKER
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLXRIXHXKEXIR

SEQ ID NO: 26080 - protein, 17 aa, Artificial Sequence
  Description of Artificial Sequence: Synthetic peptide
  Seed: GIPRLERILHAKERIRF (GTF2I L424H)
  Core: ERILHAKER
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLXRIXHXKEXIRF

SEQ ID NO: 26081 - protein, 17 aa, Artificial Sequence
  Description of Artificial Sequence: Synthetic peptide
  Seed: GIPRLERILHAKERIRF (GTF2I L424H)
  Core: ILHAKERIR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERXLHXKXRIXF

SEQ ID NO: 26082 - protein, 18 aa, Artificial Sequence
  Description of Artificial Sequence: Synthetic peptide
  Seed: GIPRLERILHAKERIRFV (GTF2I L424H)
  Core: ILHAKERIR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERXLHXKXRIXFV

SEQ ID NO: 26083 - protein, 18 aa, Artificial Sequence
  Description of Artificial Sequence: Synthetic peptide
  Seed: GIPRLERILHAKERIRFV (GTF2I L424H)
  Core: LHAKERIRF
  misc_feature (9)..(9): Xaa can be Ala, Cys, Phe, Gly, Ile, Leu, Met, Asn, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERIXHAXEXIRXV

SEQ ID NO: 26084 - protein, 19 aa, Artificial Sequence
  Description of Artificial Sequence: Synthetic peptide
  Seed: GIPRLERILHAKERIRFVI (GTF2I L424H)
  Core: PRLERILHA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXRLXRXLHXKERIRFVI

SEQ ID NO: 26085 - protein, 19 aa, Artificial Sequence
  Description of Artificial Sequence: Synthetic peptide
  Seed: GIPRLERILHAKERIRFVI (GTF2I L424H)
  Core: ERILHAKER
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLXRIXHXKEXIRFVI

SEQ ID NO: 26086 - protein, 19 aa, Artificial Sequence
  Description of Artificial Sequence: Synthetic peptide
  Seed: GIPRLERILHAKERIRFVI (GTF2I L424H)
  Core: ILHAKERIR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERXLHXKXRIXFVI

SEQ ID NO: 26087 - protein, 19 aa, Artificial Sequence
  Description of Artificial Sequence: Synthetic peptide
  Seed: GIPRLERILHAKERIRFVI (GTF2I L424H)
  Core: LHAKERIRF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERIXHAXEXIRXVI

SEQ ID NO: 26088 - protein, 20 aa, Artificial Sequence
  Description of Artificial Sequence: Synthetic peptide
  Seed: GIPRLERILHAKERIRFVIK (GTF2I L424H)
  Core: PRLERILHA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXRLXRXLHXKERIRFVIK

SEQ ID NO: 26089 - protein, 20 aa, Artificial Sequence
  Description of Artificial Sequence: Synthetic peptide
  Seed: GIPRLERILHAKERIRFVIK (GTF2I L424H)
  Core: ERILHAKER
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLXRIXHXKEXIRFVIK

SEQ ID NO: 26090 - protein, 20 aa, Artificial Sequence
  Description of Artificial Sequence: Synthetic peptide
  Seed: GIPRLERILHAKERIRFVIK (GTF2I L424H)
  Core: ILHAKERIR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERXLHXKXRIXFVIK

SEQ ID NO: 26091 - protein, 20 aa, Artificial Sequence
  Description of Artificial Sequence: Synthetic peptide
  Seed: GIPRLERILHAKERIRFVIK (GTF2I L424H)
  Core: LHAKERIRF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERIXHAXEXIRXVIK

SEQ ID NO: 26092 - protein, 21 aa, Artificial Sequence
  Description of Artificial Sequence: Synthetic peptide
  Seed: GIPRLERILHAKERIRFVIKK (GTF2I L424H)
  Core: ERILHAKER
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLXRIXHXKEXIRFVIKK

SEQ ID NO: 26093 - protein, 21 aa, Artificial Sequence
  Description of Artificial Sequence: Synthetic peptide
  Seed: GIPRLERILHAKERIRFVIKK (GTF2I L424H)
  Core: ILHAKERIR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERXLHXKXRIXFVIKK

SEQ ID NO: 26094 - protein, 21 aa, Artificial Sequence
  Description of Artificial Sequence: Synthetic peptide
  Seed: GIPRLERILHAKERIRFVIKK (GTF2I L424H)
  Core: LHAKERIRF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERIXHAXEXIRXVIKK

SEQ ID NO: 26095 - protein, 22 aa, Artificial Sequence
  Description of Artificial Sequence: Synthetic peptide
  Seed: GIPRLERILHAKERIRFVIKKH (GTF2I L424H)
  Core: ERILHAKER
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLXRIXHXKEXIRFVIKKH

SEQ ID NO: 26096 - protein, 22 aa, Artificial Sequence
  Description of Artificial Sequence: Synthetic peptide
  Seed: GIPRLERILHAKERIRFVIKKH (GTF2I L424H)
  Core: ILHAKERIR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERXLHXKXRIXFVIKKH

SEQ ID NO: 26097 - protein, 22 aa, Artificial Sequence
  Description of Artificial Sequence: Synthetic peptide
  Seed: GIPRLERILHAKERIRFVIKKH (GTF2I L424H)
  Core: LHAKERIRF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERIXHAXEXIRXVIKKH

SEQ ID NO: 26098 - protein, 23 aa, Artificial Sequence
  Description of Artificial Sequence: Synthetic peptide
  Seed: GIPRLERILHAKERIRFVIKKHE (GTF2I L424H)
  Core: PRLERILHA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXRLXRXLHXKERIRFVIKKHE

SEQ ID NO: 26099 - protein, 23 aa, Artificial Sequence
  Description of Artificial Sequence: Synthetic peptide
  Seed: GIPRLERILHAKERIRFVIKKHE (GTF2I L424H)
  Core: ERILHAKER
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLXRIXHXKEXIRFVIKKHE

SEQ ID NO: 26100 - protein, 23 aa, Artificial Sequence
  Description of Artificial Sequence: Synthetic peptide
  Seed: GIPRLERILHAKERIRFVIKKHE (GTF2I L424H)
  Core: ILHAKERIR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERXLHXKXRIXFVIKKHE

SEQ ID NO: 26101 - protein, 23 aa, Artificial Sequence
  Description of Artificial Sequence: Synthetic peptide
  Seed: GIPRLERILHAKERIRFVIKKHE (GTF2I L424H)
  Core: LHAKERIRF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERIXHAXEXIRXVIKKHE

SEQ ID NO: 26102 - protein, 24 aa, Artificial Sequence
  Description of Artificial Sequence: Synthetic peptide
  Seed: GIPRLERILHAKERIRFVIKKHEL (GTF2I L424H)
  Core: PRLERILHA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXRLXRXLHXKERIRFVIKKHEL

SEQ ID NO: 26103 - protein, 24 aa, Artificial Sequence
  Description of Artificial Sequence: Synthetic peptide
  Seed: GIPRLERILHAKERIRFVIKKHEL (GTF2I L424H)
  Core: ERILHAKER
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLXRIXHXKEXIRFVIKKHEL

SEQ ID NO: 26104 - protein, 24 aa, Artificial Sequence
  Description of Artificial Sequence: Synthetic peptide
  Seed: GIPRLERILHAKERIRFVIKKHEL (GTF2I L424H)
  Core: ILHAKERIR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERXLHXKXRIXFVIKKHEL

SEQ ID NO: 26105 - protein, 24 aa, Artificial Sequence
  Description of Artificial Sequence: Synthetic peptide
  Seed: GIPRLERILHAKERIRFVIKKHEL (GTF2I L424H)
  Core: LHAKERIRF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERIXHAXEXIRXVIKKHEL

SEQ ID NO: 26106 - protein, 25 aa, Artificial Sequence
  Description of Artificial Sequence: Synthetic peptide
  Seed: GIPRLERILHAKERIRFVIKKHELL (GTF2I L424H)
  Core: PRLERILHA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXRLXRXLHXKERIRFVIKKHELL

SEQ ID NO: 26107 - protein, 25 aa, Artificial Sequence
  Description of Artificial Sequence: Synthetic peptide
  Seed: GIPRLERILHAKERIRFVIKKHELL (GTF2I L424H)
  Core: ILHAKERIR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERXLHXKXRIXFVIKKHELL

SEQ ID NO: 26108 - protein, 25 aa, Artificial Sequence
  Description of Artificial Sequence: Synthetic peptide
  Seed: GIPRLERILHAKERIRFVIKKHELL (GTF2I L424H)
  Core: LHAKERIRF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GIPRLERIXHAXEXIRXVIKKHELL

SEQ ID NO: 26109 - protein, 13 aa, Artificial Sequence
  Description of Artificial Sequence: Synthetic peptide
  Seed: ILHAKERIRFVIK (GTF2I L424H)
  Core: LHAKERIRF
  misc_feature (2)..(2): Xaa can be Ala, Cys, Phe, Gly, His, Ile, Lys, Leu, Met, Asn, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXHAXEXIRXVIK

SEQ ID NO: 26110 - protein, 14 aa, Artificial Sequence
  Description of Artificial Sequence: Synthetic peptide
  Seed: ILHAKERIRFVIKK (GTF2I L424H)
  Core: LHAKERIRF
  misc_feature (2)..(2): Xaa can be Ala, Cys, Asp, Glu, Phe, Gly, His, Ile, Leu, Met, Asn, Pro, Gln, Ser, Thr, Val, Trp, or Ty r
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXHAXEXIRXVIKK

SEQ ID NO: 26111 - protein, 15 aa, Artificial Sequence
  Description of Artificial Sequence: Synthetic peptide
  Seed: ILHAKERIRFVIKKH (GTF2I L424H)
  Core: LHAKERIRF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXHAXEXIRXVIKKH

SEQ ID NO: 26112 - protein, 22 aa, Artificial Sequence
  Description of Artificial Sequence: Synthetic peptide
  Seed: IPFRRPSTYGIPRLERILHAKE (GTF2I L424H)
  Core: PRLERILHA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IPFRRPSTYGIXRLXRXLHXKE

SEQ ID NO: 26113 - protein, 23 aa, Artificial Sequence
  Description of Artificial Sequence: Synthetic peptide
  Seed: IPFRRPSTYGIPRLERILHAKER (GTF2I L424H)
  Core: PRLERILHA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IPFRRPSTYGIXRLXRXLHXKER

SEQ ID NO: 26114 - protein, 24 aa, Artificial Sequence
  Description of Artificial Sequence: Synthetic peptide
  Seed: IPFRRPSTYGIPRLERILHAKERI (GTF2I L424H)
  Core: PRLERILHA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IPFRRPSTYGIXRLXRXLHXKERI

SEQ ID NO: 26115 - protein, 25 aa, Artificial Sequence
  Description of Artificial Sequence: Synthetic peptide
  Seed: IPFRRPSTYGIPRLERILHAKERIR (GTF2I L424H)
  Core: PRLERILHA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IPFRRPSTYGIXRLXRXLHXKERIR

SEQ ID NO: 26116 - protein, 15 aa, Artificial Sequence
  Description of Artificial Sequence: Synthetic peptide
  Seed: IPRLERILHAKERIR (GTF2I L424H)
  Core: ERILHAKER
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IPRLXRIXHXKEXIR

SEQ ID NO: 26117 - protein, 16 aa, Artificial Sequence
  Description of Artificial Sequence: Synthetic peptide
  Seed: IPRLERILHAKERIRF (GTF2I L424H)
  Core: ERILHAKER
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IPRLXRIXHXKEXIRF

SEQ ID NO: 26118 - protein, 16 aa, Artificial Sequence
  Description of Artificial Sequence: Synthetic peptide
  Seed: IPRLERILHAKERIRF (GTF2I L424H)
  Core: ILHAKERIR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERXLHXKXRIXF

SEQ ID NO: 26119 - protein, 16 aa, Artificial Sequence
  Description of Artificial Sequence: Synthetic peptide
  Seed: IPRLERILHAKERIRF (GTF2I L424H)
  Core: LHAKERIRF
  misc_feature (8)..(8): Xaa can be Phe, Ile, Leu, Met, Val, Trp, or Tyr
  misc_feature (11)..(11): Xaa can be Ala, Cys, Asp, Glu, Phe, His, Ile, Lys, Leu, Met, Asn, Gln, Arg, Ser, Thr, Val, Trp, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERIXHAXEXIRX

SEQ ID NO: 26120 - protein, 17 aa, Artificial Sequence
  Description of Artificial Sequence: Synthetic peptide
  Seed: IPRLERILHAKERIRFV (GTF2I L424H)
  Core: ERILHAKER
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IPRLXRIXHXKEXIRFV

SEQ ID NO: 26121 - protein, 17 aa, Artificial Sequence
  Description of Artificial Sequence: Synthetic peptide
  Seed: IPRLERILHAKERIRFV (GTF2I L424H)
  Core: ILHAKERIR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERXLHXKXRIXFV

SEQ ID NO: 26122 - protein, 17 aa, Artificial Sequence
  Description of Artificial Sequence: Synthetic peptide
  Seed: IPRLERILHAKERIRFV (GTF2I L424H)
  Core: LHAKERIRF
  misc_feature (8)..(8): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERIXHAXEXIRXV

SEQ ID NO: 26123 - protein, 18 aa, Artificial Sequence
  Description of Artificial Sequence: Synthetic peptide
  Seed: IPRLERILHAKERIRFVI (GTF2I L424H)
  Core: ILHAKERIR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERXLHXKXRIXFVI

SEQ ID NO: 26124 - protein, 18 aa, Artificial Sequence
  Description of Artificial Sequence: Synthetic peptide
  Seed: IPRLERILHAKERIRFVI (GTF2I L424H)
  Core: LHAKERIRF
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERIXHAXEXIRXVI

SEQ ID NO: 26125 - protein, 19 aa, Artificial Sequence
  Description of Artificial Sequence: Synthetic peptide
  Seed: IPRLERILHAKERIRFVIK (GTF2I L424H)
  Core: ERILHAKER
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IPRLXRIXHXKEXIRFVIK

SEQ ID NO: 26126 - protein, 19 aa, Artificial Sequence
  Description of Artificial Sequence: Synthetic peptide
  Seed: IPRLERILHAKERIRFVIK (GTF2I L424H)
  Core: ILHAKERIR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERXLHXKXRIXFVIK

SEQ ID NO: 26127 - protein, 19 aa, Artificial Sequence
  Description of Artificial Sequence: Synthetic peptide
  Seed: IPRLERILHAKERIRFVIK (GTF2I L424H)
  Core: LHAKERIRF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERIXHAXEXIRXVIK

SEQ ID NO: 26128 - protein, 20 aa, Artificial Sequence
  Description of Artificial Sequence: Synthetic peptide
  Seed: IPRLERILHAKERIRFVIKK (GTF2I L424H)
  Core: ERILHAKER
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IPRLXRIXHXKEXIRFVIKK

SEQ ID NO: 26129 - protein, 20 aa, Artificial Sequence
  Description of Artificial Sequence: Synthetic peptide
  Seed: IPRLERILHAKERIRFVIKK (GTF2I L424H)
  Core: ILHAKERIR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERXLHXKXRIXFVIKK

SEQ ID NO: 26130 - protein, 20 aa, Artificial Sequence
  Description of Artificial Sequence: Synthetic peptide
  Seed: IPRLERILHAKERIRFVIKK (GTF2I L424H)
  Core: LHAKERIRF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERIXHAXEXIRXVIKK

SEQ ID NO: 26131 - protein, 21 aa, Artificial Sequence
  Description of Artificial Sequence: Synthetic peptide
  Seed: IPRLERILHAKERIRFVIKKH (GTF2I L424H)
  Core: ERILHAKER
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IPRLXRIXHXKEXIRFVIKKH

SEQ ID NO: 26132 - protein, 21 aa, Artificial Sequence
  Description of Artificial Sequence: Synthetic peptide
  Seed: IPRLERILHAKERIRFVIKKH (GTF2I L424H)
  Core: ILHAKERIR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERXLHXKXRIXFVIKKH

SEQ ID NO: 26133 - protein, 21 aa, Artificial Sequence
  Description of Artificial Sequence: Synthetic peptide
  Seed: IPRLERILHAKERIRFVIKKH (GTF2I L424H)
  Core: LHAKERIRF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERIXHAXEXIRXVIKKH

SEQ ID NO: 26134 - protein, 22 aa, Artificial Sequence
  Description of Artificial Sequence: Synthetic peptide
  Seed: IPRLERILHAKERIRFVIKKHE (GTF2I L424H)
  Core: ERILHAKER
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IPRLXRIXHXKEXIRFVIKKHE

SEQ ID NO: 26135 - protein, 22 aa, Artificial Sequence
  Description of Artificial Sequence: Synthetic peptide
  Seed: IPRLERILHAKERIRFVIKKHE (GTF2I L424H)
  Core: ILHAKERIR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERXLHXKXRIXFVIKKHE

SEQ ID NO: 26136 - protein, 22 aa, Artificial Sequence
  Description of Artificial Sequence: Synthetic peptide
  Seed: IPRLERILHAKERIRFVIKKHE (GTF2I L424H)
  Core: LHAKERIRF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERIXHAXEXIRXVIKKHE

SEQ ID NO: 26137 - protein, 23 aa, Artificial Sequence
  Description of Artificial Sequence: Synthetic peptide
  Seed: IPRLERILHAKERIRFVIKKHEL (GTF2I L424H)
  Core: ERILHAKER
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IPRLXRIXHXKEXIRFVIKKHEL

SEQ ID NO: 26138 - protein, 23 aa, Artificial Sequence
  Description of Artificial Sequence: Synthetic peptide
  Seed: IPRLERILHAKERIRFVIKKHEL (GTF2I L424H)
  Core: ILHAKERIR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERXLHXKXRIXFVIKKHEL

SEQ ID NO: 26139 - protein, 23 aa, Artificial Sequence
  Description of Artificial Sequence: Synthetic peptide
  Seed: IPRLERILHAKERIRFVIKKHEL (GTF2I L424H)
  Core: LHAKERIRF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERIXHAXEXIRXVIKKHEL

SEQ ID NO: 26140 - protein, 24 aa, Artificial Sequence
  Description of Artificial Sequence: Synthetic peptide
  Seed: IPRLERILHAKERIRFVIKKHELL (GTF2I L424H)
  Core: ERILHAKER
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IPRLXRIXHXKEXIRFVIKKHELL

SEQ ID NO: 26141 - protein, 24 aa, Artificial Sequence
  Description of Artificial Sequence: Synthetic peptide
  Seed: IPRLERILHAKERIRFVIKKHELL (GTF2I L424H)
  Core: ILHAKERIR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERXLHXKXRIXFVIKKHELL

SEQ ID NO: 26142 - protein, 24 aa, Artificial Sequence
  Description of Artificial Sequence: Synthetic peptide
  Seed: IPRLERILHAKERIRFVIKKHELL (GTF2I L424H)
  Core: LHAKERIRF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERIXHAXEXIRXVIKKHELL

SEQ ID NO: 26143 - protein, 25 aa, Artificial Sequence
  Description of Artificial Sequence: Synthetic peptide
  Seed: IPRLERILHAKERIRFVIKKHELLN (GTF2I L424H)
  Core: LHAKERIRF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IPRLERIXHAXEXIRXVIKKHELLN

SEQ ID NO: 26144 - protein, 13 aa, Artificial Sequence
  Description of Artificial Sequence: Synthetic peptide
  Seed: LERILHAKERIRF (GTF2I L424H)
  Core: ILHAKERIR
  misc_feature (4)..(4): Xaa can be Ala, Cys, Phe, Gly, His, Ile, Lys, Leu, Met, Asn, Pro, Gln, Arg, Ser, Thr, Val, Trp, or Ty r
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LERXLHXKXRIXF

SEQ ID NO: 26145 - protein, 13 aa, Artificial Sequence
  Description of Artificial Sequence: Synthetic peptide
  Seed: LERILHAKERIRF (GTF2I L424H)
  Core: LHAKERIRF
  misc_feature (5)..(5): Xaa can be Ala, Cys, Phe, Ile, Leu, Met, Thr, Val, Trp, or Tyr
  misc_feature (8)..(8): Xaa can be Ala, Cys, Glu, Phe, Gly, His, Ile, Lys, Leu, Met, Asn, Gln, Arg, Ser, Thr, Val, Trp, or Ty r
  misc_feature (10)..(10): Xaa can be Ala, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LERIXHAXEXIRX

SEQ ID NO: 26146 - protein, 14 aa, Artificial Sequence
  Description of Artificial Sequence: Synthetic peptide
  Seed: LERILHAKERIRFV (GTF2I L424H)
  Core: ILHAKERIR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LERXLHXKXRIXFV

SEQ ID NO: 26147 - protein, 14 aa, Artificial Sequence
  Description of Artificial Sequence: Synthetic peptide
  Seed: LERILHAKERIRFV (GTF2I L424H)
  Core: LHAKERIRF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LERIXHAXEXIRXV

SEQ ID NO: 26148 - protein, 15 aa, Artificial Sequence
  Description of Artificial Sequence: Synthetic peptide
  Seed: LERILHAKERIRFVI (GTF2I L424H)
  Core: ILHAKERIR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LERXLHXKXRIXFVI

SEQ ID NO: 26149 - protein, 15 aa, Artificial Sequence
  Description of Artificial Sequence: Synthetic peptide
  Seed: LERILHAKERIRFVI (GTF2I L424H)
  Core: LHAKERIRF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LERIXHAXEXIRXVI

SEQ ID NO: 26150 - protein, 16 aa, Artificial Sequence
  Description of Artificial Sequence: Synthetic peptide
  Seed: LERILHAKERIRFVIK (GTF2I L424H)
  Core: ILHAKERIR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LERXLHXKXRIXFVIK

SEQ ID NO: 26151 - protein, 16 aa, Artificial Sequence
  Description of Artificial Sequence: Synthetic peptide
  Seed: LERILHAKERIRFVIK (GTF2I L424H)
  Core: LHAKERIRF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LERIXHAXEXIRXVIK

SEQ ID NO: 26152 - protein, 17 aa, Artificial Sequence
  Description of Artificial Sequence: Synthetic peptide
  Seed: LERILHAKERIRFVIKK (GTF2I L424H)
  Core: ILHAKERIR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LERXLHXKXRIXFVIKK

SEQ ID NO: 26153 - protein, 17 aa, Artificial Sequence
  Description of Artificial Sequence: Synthetic peptide
  Seed: LERILHAKERIRFVIKK (GTF2I L424H)
  Core: LHAKERIRF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LERIXHAXEXIRXVIKK

SEQ ID NO: 26154 - protein, 18 aa, Artificial Sequence
  Description of Artificial Sequence: Synthetic peptide
  Seed: LERILHAKERIRFVIKKH (GTF2I L424H)
  Core: ILHAKERIR
  misc_feature (4)..(4): Xaa can be Phe, His, Ile, Leu, Met, Thr, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LERXLHXKXRIXFVIKKH

SEQ ID NO: 26155 - protein, 18 aa, Artificial Sequence
  Description of Artificial Sequence: Synthetic peptide
  Seed: LERILHAKERIRFVIKKH (GTF2I L424H)
  Core: LHAKERIRF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LERIXHAXEXIRXVIKKH

SEQ ID NO: 26156 - protein, 19 aa, Artificial Sequence
  Description of Artificial Sequence: Synthetic peptide
  Seed: LERILHAKERIRFVIKKHE (GTF2I L424H)
  Core: ILHAKERIR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LERXLHXKXRIXFVIKKHE

SEQ ID NO: 26157 - protein, 19 aa, Artificial Sequence
  Description of Artificial Sequence: Synthetic peptide
  Seed: LERILHAKERIRFVIKKHE (GTF2I L424H)
  Core: LHAKERIRF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LERIXHAXEXIRXVIKKHE

SEQ ID NO: 26158 - protein, 20 aa, Artificial Sequence
  Description of Artificial Sequence: Synthetic peptide
  Seed: LERILHAKERIRFVIKKHEL (GTF2I L424H)
  Core: ILHAKERIR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LERXLHXKXRIXFVIKKHEL

SEQ ID NO: 26159 - protein, 20 aa, Artificial Sequence
  Description of Artificial Sequence: Synthetic peptide
  Seed: LERILHAKERIRFVIKKHEL (GTF2I L424H)
  Core: LHAKERIRF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LERIXHAXEXIRXVIKKHEL

SEQ ID NO: 26160 - protein, 21 aa, Artificial Sequence
  Description of Artificial Sequence: Synthetic peptide
  Seed: LERILHAKERIRFVIKKHELL (GTF2I L424H)
  Core: ILHAKERIR
  misc_feature (4)..(4): Xaa can be Ala, Cys, Asp, Glu, Phe, Gly, His, Ile, Lys, Leu, Met, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LERXLHXKXRIXFVIKKHELL

SEQ ID NO: 26161 - protein, 21 aa, Artificial Sequence
  Description of Artificial Sequence: Synthetic peptide
  Seed: LERILHAKERIRFVIKKHELL (GTF2I L424H)
  Core: LHAKERIRF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LERIXHAXEXIRXVIKKHELL

SEQ ID NO: 26162 - protein, 23 aa, Artificial Sequence
  Description of Artificial Sequence: Synthetic peptide
  Seed: LERILHAKERIRFVIKKHELLNS (GTF2I L424H)
  Core: LHAKERIRF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LERIXHAXEXIRXVIKKHELLNS

SEQ ID NO: 26163 - protein, 25 aa, Artificial Sequence
  Description of Artificial Sequence: Synthetic peptide
  Seed: PEGIPFRRPSTYGIPRLERILHAKE (GTF2I L424H)
  Core: PRLERILHA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PEGIPFRRPSTYGIXRLXRXLHXKE

SEQ ID NO: 26164 - protein, 21 aa, Artificial Sequence
  Description of Artificial Sequence: Synthetic peptide
  Seed: PFRRPSTYGIPRLERILHAKE (GTF2I L424H)
  Core: PRLERILHA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PFRRPSTYGIXRLXRXLHXKE

SEQ ID NO: 26165 - protein, 22 aa, Artificial Sequence
  Description of Artificial Sequence: Synthetic peptide
  Seed: PFRRPSTYGIPRLERILHAKER (GTF2I L424H)
  Core: PRLERILHA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PFRRPSTYGIXRLXRXLHXKER

SEQ ID NO: 26166 - protein, 23 aa, Artificial Sequence
  Description of Artificial Sequence: Synthetic peptide
  Seed: PFRRPSTYGIPRLERILHAKERI (GTF2I L424H)
  Core: PRLERILHA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PFRRPSTYGIXRLXRXLHXKERI

SEQ ID NO: 26167 - protein, 24 aa, Artificial Sequence
  Description of Artificial Sequence: Synthetic peptide
  Seed: PFRRPSTYGIPRLERILHAKERIR (GTF2I L424H)
  Core: PRLERILHA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PFRRPSTYGIXRLXRXLHXKERIR

SEQ ID NO: 26168 - protein, 25 aa, Artificial Sequence
  Description of Artificial Sequence: Synthetic peptide
  Seed: PFRRPSTYGIPRLERILHAKERIRF (GTF2I L424H)
  Core: PRLERILHA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PFRRPSTYGIXRLXRXLHXKERIRF

SEQ ID NO: 26169 - protein, 25 aa, Artificial Sequence
  Description of Artificial Sequence: Synthetic peptide
  Seed: PFRRPSTYGIPRLERILHAKERIRF (GTF2I L424H)
  Core: ERILHAKER
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PFRRPSTYGIPRLXRIXHXKEXIRF

SEQ ID NO: 26170 - protein, 25 aa, Artificial Sequence
  Description of Artificial Sequence: Synthetic peptide
  Seed: PFRRPSTYGIPRLERILHAKERIRF (GTF2I L424H)
  Core: ILHAKERIR
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
PFRRPSTYGIPRLERXLHXKXRIXF

SEQ ID NO: 26171 - protein, 14 aa, Artificial Sequence
  Description of Artificial Sequence: Synthetic peptide
  Seed: PRLERILHAKERIR (GTF2I L424H)
  Core: ILHAKERIR
  misc_feature (6)..(6): Xaa can be Phe, Ile, Leu, Met, Val, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Gly, His, Ile, Lys, Leu, Asn, Pro, Gln, Arg, Ser, Thr, Val, or Trp
  misc_feature (14)..(14): Xaa can be Ala, Cys, Glu, Phe, Gly, His, Ile, Lys, Leu, Met, Asn, Gln, Arg, Ser, Thr, Val, Trp, or Ty r
PRLERXLHXKXRIX

SEQ ID NO: 26172 - protein, 15 aa, Artificial Sequence
  Description of Artificial Sequence: Synthetic peptide
  Seed: PRLERILHAKERIRF (GTF2I L424H)
  Core: ERILHAKER
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PRLXRIXHXKEXIRF

SEQ ID NO: 26173 - protein, 15 aa, Artificial Sequence
  Description of Artificial Sequence: Synthetic peptide
  Seed: PRLERILHAKERIRF (GTF2I L424H)
  Core: ILHAKERIR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRLERXLHXKXRIXF

SEQ ID NO: 26174 - protein, 15 aa, Artificial Sequence
  Description of Artificial Sequence: Synthetic peptide
  Seed: PRLERILHAKERIRF (GTF2I L424H)
  Core: LHAKERIRF
  misc_feature (7)..(7): Xaa can be Ala, Cys, Phe, His, Ile, Leu, Met, Gln, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PRLERIXHAXEXIRX

SEQ ID NO: 26175 - protein, 16 aa, Artificial Sequence
  Description of Artificial Sequence: Synthetic peptide
  Seed: PRLERILHAKERIRFV (GTF2I L424H)
  Core: ERILHAKER
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PRLXRIXHXKEXIRFV

SEQ ID NO: 26176 - protein, 16 aa, Artificial Sequence
  Description of Artificial Sequence: Synthetic peptide
  Seed: PRLERILHAKERIRFV (GTF2I L424H)
  Core: ILHAKERIR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRLERXLHXKXRIXFV

SEQ ID NO: 26177 - protein, 16 aa, Artificial Sequence
  Description of Artificial Sequence: Synthetic peptide
  Seed: PRLERILHAKERIRFV (GTF2I L424H)
  Core: LHAKERIRF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PRLERIXHAXEXIRXV

SEQ ID NO: 26178 - protein, 17 aa, Artificial Sequence
  Description of Artificial Sequence: Synthetic peptide
  Seed: PRLERILHAKERIRFVI (GTF2I L424H)
  Core: ERILHAKER
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PRLXRIXHXKEXIRFVI

SEQ ID NO: 26179 - protein, 17 aa, Artificial Sequence
  Description of Artificial Sequence: Synthetic peptide
  Seed: PRLERILHAKERIRFVI (GTF2I L424H)
  Core: ILHAKERIR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRLERXLHXKXRIXFVI

SEQ ID NO: 26180 - protein, 17 aa, Artificial Sequence
  Description of Artificial Sequence: Synthetic peptide
  Seed: PRLERILHAKERIRFVI (GTF2I L424H)
  Core: LHAKERIRF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PRLERIXHAXEXIRXVI

SEQ ID NO: 26181 - protein, 18 aa, Artificial Sequence
  Description of Artificial Sequence: Synthetic peptide
  Seed: PRLERILHAKERIRFVIK (GTF2I L424H)
  Core: ERILHAKER
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PRLXRIXHXKEXIRFVIK

SEQ ID NO: 26182 - protein, 18 aa, Artificial Sequence
  Description of Artificial Sequence: Synthetic peptide
  Seed: PRLERILHAKERIRFVIK (GTF2I L424H)
  Core: ILHAKERIR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRLERXLHXKXRIXFVIK

SEQ ID NO: 26183 - protein, 18 aa, Artificial Sequence
  Description of Artificial Sequence: Synthetic peptide
  Seed: PRLERILHAKERIRFVIK (GTF2I L424H)
  Core: LHAKERIRF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PRLERIXHAXEXIRXVIK

SEQ ID NO: 26184 - protein, 19 aa, Artificial Sequence
  Description of Artificial Sequence: Synthetic peptide
  Seed: PRLERILHAKERIRFVIKK (GTF2I L424H)
  Core: ERILHAKER
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PRLXRIXHXKEXIRFVIKK

SEQ ID NO: 26185 - protein, 19 aa, Artificial Sequence
  Description of Artificial Sequence: Synthetic peptide
  Seed: PRLERILHAKERIRFVIKK (GTF2I L424H)
  Core: ILHAKERIR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRLERXLHXKXRIXFVIKK

SEQ ID NO: 26186 - protein, 19 aa, Artificial Sequence
  Description of Artificial Sequence: Synthetic peptide
  Seed: PRLERILHAKERIRFVIKK (GTF2I L424H)
  Core: LHAKERIRF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PRLERIXHAXEXIRXVIKK

SEQ ID NO: 26187 - protein, 20 aa, Artificial Sequence
  Description of Artificial Sequence: Synthetic peptide
  Seed: PRLERILHAKERIRFVIKKH (GTF2I L424H)
  Core: ERILHAKER
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PRLXRIXHXKEXIRFVIKKH

SEQ ID NO: 26188 - protein, 20 aa, Artificial Sequence
  Description of Artificial Sequence: Synthetic peptide
  Seed: PRLERILHAKERIRFVIKKH (GTF2I L424H)
  Core: ILHAKERIR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRLERXLHXKXRIXFVIKKH

SEQ ID NO: 26189 - protein, 20 aa, Artificial Sequence
  Description of Artificial Sequence: Synthetic peptide
  Seed: PRLERILHAKERIRFVIKKH (GTF2I L424H)
  Core: LHAKERIRF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PRLERIXHAXEXIRXVIKKH

SEQ ID NO: 26190 - protein, 21 aa, Artificial Sequence
  Description of Artificial Sequence: Synthetic peptide
  Seed: PRLERILHAKERIRFVIKKHE (GTF2I L424H)
  Core: ILHAKERIR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRLERXLHXKXRIXFVIKKHE

SEQ ID NO: 26191 - protein, 21 aa, Artificial Sequence
  Description of Artificial Sequence: Synthetic peptide
  Seed: PRLERILHAKERIRFVIKKHE (GTF2I L424H)
  Core: LHAKERIRF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PRLERIXHAXEXIRXVIKKHE

SEQ ID NO: 26192 - protein, 22 aa, Artificial Sequence
  Description of Artificial Sequence: Synthetic peptide
  Seed: PRLERILHAKERIRFVIKKHEL (GTF2I L424H)
  Core: ILHAKERIR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRLERXLHXKXRIXFVIKKHEL

SEQ ID NO: 26193 - protein, 22 aa, Artificial Sequence
  Description of Artificial Sequence: Synthetic peptide
  Seed: PRLERILHAKERIRFVIKKHEL (GTF2I L424H)
  Core: LHAKERIRF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PRLERIXHAXEXIRXVIKKHEL

SEQ ID NO: 26194 - protein, 23 aa, Artificial Sequence
  Description of Artificial Sequence: Synthetic peptide
  Seed: PRLERILHAKERIRFVIKKHELL (GTF2I L424H)
  Core: ILHAKERIR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRLERXLHXKXRIXFVIKKHELL

SEQ ID NO: 26195 - protein, 23 aa, Artificial Sequence
  Description of Artificial Sequence: Synthetic peptide
  Seed: PRLERILHAKERIRFVIKKHELL (GTF2I L424H)
  Core: LHAKERIRF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PRLERIXHAXEXIRXVIKKHELL

SEQ ID NO: 26196 - protein, 24 aa, Artificial Sequence
  Description of Artificial Sequence: Synthetic peptide
  Seed: PRLERILHAKERIRFVIKKHELLN (GTF2I L424H)
  Core: LHAKERIRF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PRLERIXHAXEXIRXVIKKHELLN

SEQ ID NO: 26197 - protein, 25 aa, Artificial Sequence
  Description of Artificial Sequence: Synthetic peptide
  Seed: PRLERILHAKERIRFVIKKHELLNS (GTF2I L424H)
  Core: LHAKERIRF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PRLERIXHAXEXIRXVIKKHELLNS

SEQ ID NO: 26198 - protein, 15 aa, Artificial Sequence
  Description of Artificial Sequence: Synthetic peptide
  Seed: PSTYGIPRLERILHA (GTF2I L424H)
  Core: PRLERILHA
  misc_feature (7)..(7): Xaa can be Ala, Cys, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIXRLXRXLHX

SEQ ID NO: 26199 - protein, 17 aa, Artificial Sequence
  Description of Artificial Sequence: Synthetic peptide
  Seed: PSTYGIPRLERILHAKE (GTF2I L424H)
  Core: PRLERILHA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIXRLXRXLHXKE

SEQ ID NO: 26200 - protein, 18 aa, Artificial Sequence
  Description of Artificial Sequence: Synthetic peptide
  Seed: PSTYGIPRLERILHAKER (GTF2I L424H)
  Core: PRLERILHA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIXRLXRXLHXKER

SEQ ID NO: 26201 - protein, 19 aa, Artificial Sequence
  Description of Artificial Sequence: Synthetic peptide
  Seed: PSTYGIPRLERILHAKERI (GTF2I L424H)
  Core: PRLERILHA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIXRLXRXLHXKERI

SEQ ID NO: 26202 - protein, 20 aa, Artificial Sequence
  Description of Artificial Sequence: Synthetic peptide
  Seed: PSTYGIPRLERILHAKERIR (GTF2I L424H)
  Core: PRLERILHA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIXRLXRXLHXKERIR

SEQ ID NO: 26203 - protein, 21 aa, Artificial Sequence
  Description of Artificial Sequence: Synthetic peptide
  Seed: PSTYGIPRLERILHAKERIRF (GTF2I L424H)
  Core: PRLERILHA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIXRLXRXLHXKERIRF

SEQ ID NO: 26204 - protein, 21 aa, Artificial Sequence
  Description of Artificial Sequence: Synthetic peptide
  Seed: PSTYGIPRLERILHAKERIRF (GTF2I L424H)
  Core: ILHAKERIR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIPRLERXLHXKXRIXF

SEQ ID NO: 26205 - protein, 22 aa, Artificial Sequence
  Description of Artificial Sequence: Synthetic peptide
  Seed: PSTYGIPRLERILHAKERIRFV (GTF2I L424H)
  Core: PRLERILHA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIXRLXRXLHXKERIRFV

SEQ ID NO: 26206 - protein, 22 aa, Artificial Sequence
  Description of Artificial Sequence: Synthetic peptide
  Seed: PSTYGIPRLERILHAKERIRFV (GTF2I L424H)
  Core: ERILHAKER
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIPRLXRIXHXKEXIRFV

SEQ ID NO: 26207 - protein, 22 aa, Artificial Sequence
  Description of Artificial Sequence: Synthetic peptide
  Seed: PSTYGIPRLERILHAKERIRFV (GTF2I L424H)
  Core: ILHAKERIR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIPRLERXLHXKXRIXFV

SEQ ID NO: 26208 - protein, 22 aa, Artificial Sequence
  Description of Artificial Sequence: Synthetic peptide
  Seed: PSTYGIPRLERILHAKERIRFV (GTF2I L424H)
  Core: LHAKERIRF
  misc_feature (13)..(13): Xaa can be Ala, Cys, Asp, Glu, Phe, Gly, His, Ile, Leu, Met, Asn, Pro, Gln, Ser, Thr, Val, Trp, or Ty r
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIPRLERIXHAXEXIRXV

SEQ ID NO: 26209 - protein, 23 aa, Artificial Sequence
  Description of Artificial Sequence: Synthetic peptide
  Seed: PSTYGIPRLERILHAKERIRFVI (GTF2I L424H)
  Core: PRLERILHA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIXRLXRXLHXKERIRFVI

SEQ ID NO: 26210 - protein, 23 aa, Artificial Sequence
  Description of Artificial Sequence: Synthetic peptide
  Seed: PSTYGIPRLERILHAKERIRFVI (GTF2I L424H)
  Core: ERILHAKER
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIPRLXRIXHXKEXIRFVI

SEQ ID NO: 26211 - protein, 23 aa, Artificial Sequence
  Description of Artificial Sequence: Synthetic peptide
  Seed: PSTYGIPRLERILHAKERIRFVI (GTF2I L424H)
  Core: ILHAKERIR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIPRLERXLHXKXRIXFVI

SEQ ID NO: 26212 - protein, 23 aa, Artificial Sequence
  Description of Artificial Sequence: Synthetic peptide
  Seed: PSTYGIPRLERILHAKERIRFVI (GTF2I L424H)
  Core: LHAKERIRF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIPRLERIXHAXEXIRXVI

SEQ ID NO: 26213 - protein, 24 aa, Artificial Sequence
  Description of Artificial Sequence: Synthetic peptide
  Seed: PSTYGIPRLERILHAKERIRFVIK (GTF2I L424H)
  Core: PRLERILHA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIXRLXRXLHXKERIRFVIK

SEQ ID NO: 26214 - protein, 24 aa, Artificial Sequence
  Description of Artificial Sequence: Synthetic peptide
  Seed: PSTYGIPRLERILHAKERIRFVIK (GTF2I L424H)
  Core: ERILHAKER
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIPRLXRIXHXKEXIRFVIK

SEQ ID NO: 26215 - protein, 24 aa, Artificial Sequence
  Description of Artificial Sequence: Synthetic peptide
  Seed: PSTYGIPRLERILHAKERIRFVIK (GTF2I L424H)
  Core: ILHAKERIR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIPRLERXLHXKXRIXFVIK

SEQ ID NO: 26216 - protein, 24 aa, Artificial Sequence
  Description of Artificial Sequence: Synthetic peptide
  Seed: PSTYGIPRLERILHAKERIRFVIK (GTF2I L424H)
  Core: LHAKERIRF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIPRLERIXHAXEXIRXVIK

SEQ ID NO: 26217 - protein, 25 aa, Artificial Sequence
  Description of Artificial Sequence: Synthetic peptide
  Seed: PSTYGIPRLERILHAKERIRFVIKK (GTF2I L424H)
  Core: PRLERILHA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIXRLXRXLHXKERIRFVIKK

SEQ ID NO: 26218 - protein, 25 aa, Artificial Sequence
  Description of Artificial Sequence: Synthetic peptide
  Seed: PSTYGIPRLERILHAKERIRFVIKK (GTF2I L424H)
  Core: ERILHAKER
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIPRLXRIXHXKEXIRFVIKK

SEQ ID NO: 26219 - protein, 25 aa, Artificial Sequence
  Description of Artificial Sequence: Synthetic peptide
  Seed: PSTYGIPRLERILHAKERIRFVIKK (GTF2I L424H)
  Core: ILHAKERIR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIPRLERXLHXKXRIXFVIKK

SEQ ID NO: 26220 - protein, 25 aa, Artificial Sequence
  Description of Artificial Sequence: Synthetic peptide
  Seed: PSTYGIPRLERILHAKERIRFVIKK (GTF2I L424H)
  Core: LHAKERIRF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PSTYGIPRLERIXHAXEXIRXVIKK

SEQ ID NO: 26221 - protein, 13 aa, Artificial Sequence
  Description of Artificial Sequence: Synthetic peptide
  Seed: RILHAKERIRFVI (GTF2I L424H)
  Core: LHAKERIRF
  misc_feature (3)..(3): Xaa can be Ala, Cys, Phe, Gly, His, Ile, Lys, Leu, Met, Asn, Pro, Gln, Arg, Ser, Thr, Val, Trp, or Ty r
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RIXHAXEXIRXVI

SEQ ID NO: 26222 - protein, 14 aa, Artificial Sequence
  Description of Artificial Sequence: Synthetic peptide
  Seed: RILHAKERIRFVIK (GTF2I L424H)
  Core: ILHAKERIR
  misc_feature (2)..(2): Xaa can be Ala, Cys, Phe, His, Ile, Lys, Leu, Met, Gln, Arg, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXLHXKXRIXFVIK

SEQ ID NO: 26223 - protein, 14 aa, Artificial Sequence
  Description of Artificial Sequence: Synthetic peptide
  Seed: RILHAKERIRFVIK (GTF2I L424H)
  Core: LHAKERIRF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RIXHAXEXIRXVIK

SEQ ID NO: 26224 - protein, 15 aa, Artificial Sequence
  Description of Artificial Sequence: Synthetic peptide
  Seed: RILHAKERIRFVIKK (GTF2I L424H)
  Core: ILHAKERIR
  misc_feature (2)..(2): Xaa can be Ala, Cys, Glu, Phe, His, Ile, Lys, Leu, Met, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, or Va l
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXLHXKXRIXFVIKK

SEQ ID NO: 26225 - protein, 15 aa, Artificial Sequence
  Description of Artificial Sequence: Synthetic peptide
  Seed: RILHAKERIRFVIKK (GTF2I L424H)
  Core: LHAKERIRF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RIXHAXEXIRXVIKK

SEQ ID NO: 26226 - protein, 16 aa, Artificial Sequence
  Description of Artificial Sequence: Synthetic peptide
  Seed: RILHAKERIRFVIKKH (GTF2I L424H)
  Core: LHAKERIRF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RIXHAXEXIRXVIKKH

SEQ ID NO: 26227 - protein, 17 aa, Artificial Sequence
  Description of Artificial Sequence: Synthetic peptide
  Seed: RILHAKERIRFVIKKHE (GTF2I L424H)
  Core: LHAKERIRF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RIXHAXEXIRXVIKKHE

SEQ ID NO: 26228 - protein, 14 aa, Artificial Sequence
  Description of Artificial Sequence: Synthetic peptide
  Seed: RLERILHAKERIRF (GTF2I L424H)
  Core: ILHAKERIR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLERXLHXKXRIXF

SEQ ID NO: 26229 - protein, 14 aa, Artificial Sequence
  Description of Artificial Sequence: Synthetic peptide
  Seed: RLERILHAKERIRF (GTF2I L424H)
  Core: LHAKERIRF
  misc_feature (6)..(6): Xaa can be Ala, Cys, Asp, Glu, Phe, Gly, His, Ile, Leu, Met, Asn, Pro, Gln, Ser, Thr, Val, Trp, or Ty r
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLERIXHAXEXIRX

SEQ ID NO: 26230 - protein, 15 aa, Artificial Sequence
  Description of Artificial Sequence: Synthetic peptide
  Seed: RLERILHAKERIRFV (GTF2I L424H)
  Core: ILHAKERIR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLERXLHXKXRIXFV

SEQ ID NO: 26231 - protein, 15 aa, Artificial Sequence
  Description of Artificial Sequence: Synthetic peptide
  Seed: RLERILHAKERIRFV (GTF2I L424H)
  Core: LHAKERIRF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLERIXHAXEXIRXV

SEQ ID NO: 26232 - protein, 16 aa, Artificial Sequence
  Description of Artificial Sequence: Synthetic peptide
  Seed: RLERILHAKERIRFVI (GTF2I L424H)
  Core: ILHAKERIR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLERXLHXKXRIXFVI

SEQ ID NO: 26233 - protein, 16 aa, Artificial Sequence
  Description of Artificial Sequence: Synthetic peptide
  Seed: RLERILHAKERIRFVI (GTF2I L424H)
  Core: LHAKERIRF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLERIXHAXEXIRXVI

SEQ ID NO: 26234 - protein, 17 aa, Artificial Sequence
  Description of Artificial Sequence: Synthetic peptide
  Seed: RLERILHAKERIRFVIK (GTF2I L424H)
  Core: ILHAKERIR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLERXLHXKXRIXFVIK

SEQ ID NO: 26235 - protein, 17 aa, Artificial Sequence
  Description of Artificial Sequence: Synthetic peptide
  Seed: RLERILHAKERIRFVIK (GTF2I L424H)
  Core: LHAKERIRF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLERIXHAXEXIRXVIK

SEQ ID NO: 26236 - protein, 18 aa, Artificial Sequence
  Description of Artificial Sequence: Synthetic peptide
  Seed: RLERILHAKERIRFVIKK (GTF2I L424H)
  Core: ILHAKERIR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLERXLHXKXRIXFVIKK

SEQ ID NO: 26237 - protein, 18 aa, Artificial Sequence
  Description of Artificial Sequence: Synthetic peptide
  Seed: RLERILHAKERIRFVIKK (GTF2I L424H)
  Core: LHAKERIRF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLERIXHAXEXIRXVIKK

SEQ ID NO: 26238 - protein, 19 aa, Artificial Sequence
  Description of Artificial Sequence: Synthetic peptide
  Seed: RLERILHAKERIRFVIKKH (GTF2I L424H)
  Core: ILHAKERIR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLERXLHXKXRIXFVIKKH

SEQ ID NO: 26239 - protein, 19 aa, Artificial Sequence
  Description of Artificial Sequence: Synthetic peptide
  Seed: RLERILHAKERIRFVIKKH (GTF2I L424H)
  Core: LHAKERIRF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLERIXHAXEXIRXVIKKH

SEQ ID NO: 26240 - protein, 20 aa, Artificial Sequence
  Description of Artificial Sequence: Synthetic peptide
  Seed: RLERILHAKERIRFVIKKHE (GTF2I L424H)
  Core: ILHAKERIR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLERXLHXKXRIXFVIKKHE

SEQ ID NO: 26241 - protein, 20 aa, Artificial Sequence
  Description of Artificial Sequence: Synthetic peptide
  Seed: RLERILHAKERIRFVIKKHE (GTF2I L424H)
  Core: LHAKERIRF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLERIXHAXEXIRXVIKKHE

SEQ ID NO: 26242 - protein, 21 aa, Artificial Sequence
  Description of Artificial Sequence: Synthetic peptide
  Seed: RLERILHAKERIRFVIKKHEL (GTF2I L424H)
  Core: ILHAKERIR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLERXLHXKXRIXFVIKKHEL

SEQ ID NO: 26243 - protein, 21 aa, Artificial Sequence
  Description of Artificial Sequence: Synthetic peptide
  Seed: RLERILHAKERIRFVIKKHEL (GTF2I L424H)
  Core: LHAKERIRF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLERIXHAXEXIRXVIKKHEL

SEQ ID NO: 26244 - protein, 22 aa, Artificial Sequence
  Description of Artificial Sequence: Synthetic peptide
  Seed: RLERILHAKERIRFVIKKHELL (GTF2I L424H)
  Core: ILHAKERIR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLERXLHXKXRIXFVIKKHELL

SEQ ID NO: 26245 - protein, 22 aa, Artificial Sequence
  Description of Artificial Sequence: Synthetic peptide
  Seed: RLERILHAKERIRFVIKKHELL (GTF2I L424H)
  Core: LHAKERIRF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLERIXHAXEXIRXVIKKHELL

SEQ ID NO: 26246 - protein, 23 aa, Artificial Sequence
  Description of Artificial Sequence: Synthetic peptide
  Seed: RLERILHAKERIRFVIKKHELLN (GTF2I L424H)
  Core: LHAKERIRF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLERIXHAXEXIRXVIKKHELLN

SEQ ID NO: 26247 - protein, 24 aa, Artificial Sequence
  Description of Artificial Sequence: Synthetic peptide
  Seed: RLERILHAKERIRFVIKKHELLNS (GTF2I L424H)
  Core: LHAKERIRF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLERIXHAXEXIRXVIKKHELLNS

SEQ ID NO: 26248 - protein, 19 aa, Artificial Sequence
  Description of Artificial Sequence: Synthetic peptide
  Seed: RPSTYGIPRLERILHAKER (GTF2I L424H)
  Core: PRLERILHA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIXRLXRXLHXKER

SEQ ID NO: 26249 - protein, 20 aa, Artificial Sequence
  Description of Artificial Sequence: Synthetic peptide
  Seed: RPSTYGIPRLERILHAKERI (GTF2I L424H)
  Core: PRLERILHA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIXRLXRXLHXKERI

SEQ ID NO: 26250 - protein, 21 aa, Artificial Sequence
  Description of Artificial Sequence: Synthetic peptide
  Seed: RPSTYGIPRLERILHAKERIR (GTF2I L424H)
  Core: PRLERILHA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIXRLXRXLHXKERIR

SEQ ID NO: 26251 - protein, 22 aa, Artificial Sequence
  Description of Artificial Sequence: Synthetic peptide
  Seed: RPSTYGIPRLERILHAKERIRF (GTF2I L424H)
  Core: PRLERILHA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIXRLXRXLHXKERIRF

SEQ ID NO: 26252 - protein, 22 aa, Artificial Sequence
  Description of Artificial Sequence: Synthetic peptide
  Seed: RPSTYGIPRLERILHAKERIRF (GTF2I L424H)
  Core: ILHAKERIR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIPRLERXLHXKXRIXF

SEQ ID NO: 26253 - protein, 23 aa, Artificial Sequence
  Description of Artificial Sequence: Synthetic peptide
  Seed: RPSTYGIPRLERILHAKERIRFV (GTF2I L424H)
  Core: PRLERILHA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIXRLXRXLHXKERIRFV

SEQ ID NO: 26254 - protein, 23 aa, Artificial Sequence
  Description of Artificial Sequence: Synthetic peptide
  Seed: RPSTYGIPRLERILHAKERIRFV (GTF2I L424H)
  Core: ERILHAKER
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIPRLXRIXHXKEXIRFV

SEQ ID NO: 26255 - protein, 23 aa, Artificial Sequence
  Description of Artificial Sequence: Synthetic peptide
  Seed: RPSTYGIPRLERILHAKERIRFV (GTF2I L424H)
  Core: ILHAKERIR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIPRLERXLHXKXRIXFV

SEQ ID NO: 26256 - protein, 23 aa, Artificial Sequence
  Description of Artificial Sequence: Synthetic peptide
  Seed: RPSTYGIPRLERILHAKERIRFV (GTF2I L424H)
  Core: LHAKERIRF
  misc_feature (14)..(14): Xaa can be Ala, Cys, Glu, Phe, Ile, Leu, Met, Asn, Pro, Gln, Thr, Val, Trp, or Tyr
  misc_feature (17)..(17): Xaa can be Ala, Cys, Asp, Glu, Phe, Gly, His, Ile, Lys, Leu, Met, Asn, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIPRLERIXHAXEXIRXV

SEQ ID NO: 26257 - protein, 24 aa, Artificial Sequence
  Description of Artificial Sequence: Synthetic peptide
  Seed: RPSTYGIPRLERILHAKERIRFVI (GTF2I L424H)
  Core: PRLERILHA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIXRLXRXLHXKERIRFVI

SEQ ID NO: 26258 - protein, 24 aa, Artificial Sequence
  Description of Artificial Sequence: Synthetic peptide
  Seed: RPSTYGIPRLERILHAKERIRFVI (GTF2I L424H)
  Core: ERILHAKER
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIPRLXRIXHXKEXIRFVI

SEQ ID NO: 26259 - protein, 24 aa, Artificial Sequence
  Description of Artificial Sequence: Synthetic peptide
  Seed: RPSTYGIPRLERILHAKERIRFVI (GTF2I L424H)
  Core: ILHAKERIR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIPRLERXLHXKXRIXFVI

SEQ ID NO: 26260 - protein, 24 aa, Artificial Sequence
  Description of Artificial Sequence: Synthetic peptide
  Seed: RPSTYGIPRLERILHAKERIRFVI (GTF2I L424H)
  Core: LHAKERIRF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIPRLERIXHAXEXIRXVI

SEQ ID NO: 26261 - protein, 25 aa, Artificial Sequence
  Description of Artificial Sequence: Synthetic peptide
  Seed: RPSTYGIPRLERILHAKERIRFVIK (GTF2I L424H)
  Core: PRLERILHA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIXRLXRXLHXKERIRFVIK

SEQ ID NO: 26262 - protein, 25 aa, Artificial Sequence
  Description of Artificial Sequence: Synthetic peptide
  Seed: RPSTYGIPRLERILHAKERIRFVIK (GTF2I L424H)
  Core: ERILHAKER
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIPRLXRIXHXKEXIRFVIK

SEQ ID NO: 26263 - protein, 25 aa, Artificial Sequence
  Description of Artificial Sequence: Synthetic peptide
  Seed: RPSTYGIPRLERILHAKERIRFVIK (GTF2I L424H)
  Core: ILHAKERIR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIPRLERXLHXKXRIXFVIK

SEQ ID NO: 26264 - protein, 25 aa, Artificial Sequence
  Description of Artificial Sequence: Synthetic peptide
  Seed: RPSTYGIPRLERILHAKERIRFVIK (GTF2I L424H)
  Core: LHAKERIRF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RPSTYGIPRLERIXHAXEXIRXVIK

SEQ ID NO: 26265 - protein, 19 aa, Artificial Sequence
  Description of Artificial Sequence: Synthetic peptide
  Seed: RRPSTYGIPRLERILHAKE (GTF2I L424H)
  Core: PRLERILHA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RRPSTYGIXRLXRXLHXKE

SEQ ID NO: 26266 - protein, 20 aa, Artificial Sequence
  Description of Artificial Sequence: Synthetic peptide
  Seed: RRPSTYGIPRLERILHAKER (GTF2I L424H)
  Core: PRLERILHA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RRPSTYGIXRLXRXLHXKER

SEQ ID NO: 26267 - protein, 21 aa, Artificial Sequence
  Description of Artificial Sequence: Synthetic peptide
  Seed: RRPSTYGIPRLERILHAKERI (GTF2I L424H)
  Core: PRLERILHA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RRPSTYGIXRLXRXLHXKERI

SEQ ID NO: 26268 - protein, 22 aa, Artificial Sequence
  Description of Artificial Sequence: Synthetic peptide
  Seed: RRPSTYGIPRLERILHAKERIR (GTF2I L424H)
  Core: PRLERILHA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RRPSTYGIXRLXRXLHXKERIR

SEQ ID NO: 26269 - protein, 23 aa, Artificial Sequence
  Description of Artificial Sequence: Synthetic peptide
  Seed: RRPSTYGIPRLERILHAKERIRF (GTF2I L424H)
  Core: PRLERILHA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RRPSTYGIXRLXRXLHXKERIRF

SEQ ID NO: 26270 - protein, 23 aa, Artificial Sequence
  Description of Artificial Sequence: Synthetic peptide
  Seed: RRPSTYGIPRLERILHAKERIRF (GTF2I L424H)
  Core: ILHAKERIR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RRPSTYGIPRLERXLHXKXRIXF

SEQ ID NO: 26271 - protein, 24 aa, Artificial Sequence
  Description of Artificial Sequence: Synthetic peptide
  Seed: RRPSTYGIPRLERILHAKERIRFV (GTF2I L424H)
  Core: PRLERILHA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RRPSTYGIXRLXRXLHXKERIRFV

SEQ ID NO: 26272 - protein, 24 aa, Artificial Sequence
  Description of Artificial Sequence: Synthetic peptide
  Seed: RRPSTYGIPRLERILHAKERIRFV (GTF2I L424H)
  Core: ERILHAKER
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RRPSTYGIPRLXRIXHXKEXIRFV

SEQ ID NO: 26273 - protein, 24 aa, Artificial Sequence
  Description of Artificial Sequence: Synthetic peptide
  Seed: RRPSTYGIPRLERILHAKERIRFV (GTF2I L424H)
  Core: ILHAKERIR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RRPSTYGIPRLERXLHXKXRIXFV

SEQ ID NO: 26274 - protein, 24 aa, Artificial Sequence
  Description of Artificial Sequence: Synthetic peptide
  Seed: RRPSTYGIPRLERILHAKERIRFV (GTF2I L424H)
  Core: LHAKERIRF
  misc_feature (15)..(15): Xaa can be Ala, Cys, Phe, Ile, Leu, Met, Gln, Thr, Val, Trp, or Tyr
  misc_feature (18)..(18): Xaa can be Ala, Cys, Asp, Glu, Phe, Gly, His, Ile, Lys, Leu, Met, Asn, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RRPSTYGIPRLERIXHAXEXIRXV

SEQ ID NO: 26275 - protein, 25 aa, Artificial Sequence
  Description of Artificial Sequence: Synthetic peptide
  Seed: RRPSTYGIPRLERILHAKERIRFVI (GTF2I L424H)
  Core: PRLERILHA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RRPSTYGIXRLXRXLHXKERIRFVI

SEQ ID NO: 26276 - protein, 25 aa, Artificial Sequence
  Description of Artificial Sequence: Synthetic peptide
  Seed: RRPSTYGIPRLERILHAKERIRFVI (GTF2I L424H)
  Core: ERILHAKER
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RRPSTYGIPRLXRIXHXKEXIRFVI

SEQ ID NO: 26277 - protein, 25 aa, Artificial Sequence
  Description of Artificial Sequence: Synthetic peptide
  Seed: RRPSTYGIPRLERILHAKERIRFVI (GTF2I L424H)
  Core: ILHAKERIR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RRPSTYGIPRLERXLHXKXRIXFVI

SEQ ID NO: 26278 - protein, 25 aa, Artificial Sequence
  Description of Artificial Sequence: Synthetic peptide
  Seed: RRPSTYGIPRLERILHAKERIRFVI (GTF2I L424H)
  Core: LHAKERIRF
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RRPSTYGIPRLERIXHAXEXIRXVI

SEQ ID NO: 26279 - protein, 15 aa, Artificial Sequence
  Description of Artificial Sequence: Synthetic peptide
  Seed: STYGIPRLERILHAK (GTF2I L424H)
  Core: PRLERILHA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STYGIXRLXRXLHXK

SEQ ID NO: 26280 - protein, 16 aa, Artificial Sequence
  Description of Artificial Sequence: Synthetic peptide
  Seed: STYGIPRLERILHAKE (GTF2I L424H)
  Core: PRLERILHA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STYGIXRLXRXLHXKE

SEQ ID NO: 26281 - protein, 17 aa, Artificial Sequence
  Description of Artificial Sequence: Synthetic peptide
  Seed: STYGIPRLERILHAKER (GTF2I L424H)
  Core: PRLERILHA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STYGIXRLXRXLHXKER

SEQ ID NO: 26282 - protein, 18 aa, Artificial Sequence
  Description of Artificial Sequence: Synthetic peptide
  Seed: STYGIPRLERILHAKERI (GTF2I L424H)
  Core: PRLERILHA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STYGIXRLXRXLHXKERI

SEQ ID NO: 26283 - protein, 19 aa, Artificial Sequence
  Description of Artificial Sequence: Synthetic peptide
  Seed: STYGIPRLERILHAKERIR (GTF2I L424H)
  Core: PRLERILHA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STYGIXRLXRXLHXKERIR

SEQ ID NO: 26284 - protein, 20 aa, Artificial Sequence
  Description of Artificial Sequence: Synthetic peptide
  Seed: STYGIPRLERILHAKERIRF (GTF2I L424H)
  Core: PRLERILHA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STYGIXRLXRXLHXKERIRF

SEQ ID NO: 26285 - protein, 20 aa, Artificial Sequence
  Description of Artificial Sequence: Synthetic peptide
  Seed: STYGIPRLERILHAKERIRF (GTF2I L424H)
  Core: RLERILHAK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPXLEXIXHAXERIRF

SEQ ID NO: 26286 - protein, 20 aa, Artificial Sequence
  Description of Artificial Sequence: Synthetic peptide
  Seed: STYGIPRLERILHAKERIRF (GTF2I L424H)
  Core: ERILHAKER
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLXRIXHXKEXIRF

SEQ ID NO: 26287 - protein, 20 aa, Artificial Sequence
  Description of Artificial Sequence: Synthetic peptide
  Seed: STYGIPRLERILHAKERIRF (GTF2I L424H)
  Core: ILHAKERIR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLERXLHXKXRIXF

SEQ ID NO: 26288 - protein, 20 aa, Artificial Sequence
  Description of Artificial Sequence: Synthetic peptide
  Seed: STYGIPRLERILHAKERIRF (GTF2I L424H)
  Core: LHAKERIRF
  misc_feature (12)..(12): Xaa can be Ala, Cys, Asp, Glu, Phe, Gly, His, Ile, Lys, Leu, Met, Asn, Pro, Gln, Arg, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLERIXHAXEXIRX

SEQ ID NO: 26289 - protein, 21 aa, Artificial Sequence
  Description of Artificial Sequence: Synthetic peptide
  Seed: STYGIPRLERILHAKERIRFV (GTF2I L424H)
  Core: PRLERILHA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STYGIXRLXRXLHXKERIRFV

SEQ ID NO: 26290 - protein, 21 aa, Artificial Sequence
  Description of Artificial Sequence: Synthetic peptide
  Seed: STYGIPRLERILHAKERIRFV (GTF2I L424H)
  Core: ERILHAKER
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLXRIXHXKEXIRFV

SEQ ID NO: 26291 - protein, 21 aa, Artificial Sequence
  Description of Artificial Sequence: Synthetic peptide
  Seed: STYGIPRLERILHAKERIRFV (GTF2I L424H)
  Core: ILHAKERIR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLERXLHXKXRIXFV

SEQ ID NO: 26292 - protein, 21 aa, Artificial Sequence
  Description of Artificial Sequence: Synthetic peptide
  Seed: STYGIPRLERILHAKERIRFV (GTF2I L424H)
  Core: LHAKERIRF
  misc_feature (12)..(12): Xaa can be Ala, Cys, Asp, Glu, Phe, Gly, His, Ile, Leu, Met, Asn, Pro, Gln, Ser, Thr, Val, Trp, or Ty r
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLERIXHAXEXIRXV

SEQ ID NO: 26293 - protein, 22 aa, Artificial Sequence
  Description of Artificial Sequence: Synthetic peptide
  Seed: STYGIPRLERILHAKERIRFVI (GTF2I L424H)
  Core: PRLERILHA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STYGIXRLXRXLHXKERIRFVI

SEQ ID NO: 26294 - protein, 22 aa, Artificial Sequence
  Description of Artificial Sequence: Synthetic peptide
  Seed: STYGIPRLERILHAKERIRFVI (GTF2I L424H)
  Core: ERILHAKER
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLXRIXHXKEXIRFVI

SEQ ID NO: 26295 - protein, 22 aa, Artificial Sequence
  Description of Artificial Sequence: Synthetic peptide
  Seed: STYGIPRLERILHAKERIRFVI (GTF2I L424H)
  Core: ILHAKERIR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLERXLHXKXRIXFVI

SEQ ID NO: 26296 - protein, 22 aa, Artificial Sequence
  Description of Artificial Sequence: Synthetic peptide
  Seed: STYGIPRLERILHAKERIRFVI (GTF2I L424H)
  Core: LHAKERIRF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLERIXHAXEXIRXVI

SEQ ID NO: 26297 - protein, 23 aa, Artificial Sequence
  Description of Artificial Sequence: Synthetic peptide
  Seed: STYGIPRLERILHAKERIRFVIK (GTF2I L424H)
  Core: PRLERILHA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STYGIXRLXRXLHXKERIRFVIK

SEQ ID NO: 26298 - protein, 23 aa, Artificial Sequence
  Description of Artificial Sequence: Synthetic peptide
  Seed: STYGIPRLERILHAKERIRFVIK (GTF2I L424H)
  Core: ERILHAKER
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLXRIXHXKEXIRFVIK

SEQ ID NO: 26299 - protein, 23 aa, Artificial Sequence
  Description of Artificial Sequence: Synthetic peptide
  Seed: STYGIPRLERILHAKERIRFVIK (GTF2I L424H)
  Core: ILHAKERIR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLERXLHXKXRIXFVIK

SEQ ID NO: 26300 - protein, 23 aa, Artificial Sequence
  Description of Artificial Sequence: Synthetic peptide
  Seed: STYGIPRLERILHAKERIRFVIK (GTF2I L424H)
  Core: LHAKERIRF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLERIXHAXEXIRXVIK

SEQ ID NO: 26301 - protein, 24 aa, Artificial Sequence
  Description of Artificial Sequence: Synthetic peptide
  Seed: STYGIPRLERILHAKERIRFVIKK (GTF2I L424H)
  Core: PRLERILHA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STYGIXRLXRXLHXKERIRFVIKK

SEQ ID NO: 26302 - protein, 24 aa, Artificial Sequence
  Description of Artificial Sequence: Synthetic peptide
  Seed: STYGIPRLERILHAKERIRFVIKK (GTF2I L424H)
  Core: ERILHAKER
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLXRIXHXKEXIRFVIKK

SEQ ID NO: 26303 - protein, 24 aa, Artificial Sequence
  Description of Artificial Sequence: Synthetic peptide
  Seed: STYGIPRLERILHAKERIRFVIKK (GTF2I L424H)
  Core: ILHAKERIR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLERXLHXKXRIXFVIKK

SEQ ID NO: 26304 - protein, 24 aa, Artificial Sequence
  Description of Artificial Sequence: Synthetic peptide
  Seed: STYGIPRLERILHAKERIRFVIKK (GTF2I L424H)
  Core: LHAKERIRF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLERIXHAXEXIRXVIKK

SEQ ID NO: 26305 - protein, 25 aa, Artificial Sequence
  Description of Artificial Sequence: Synthetic peptide
  Seed: STYGIPRLERILHAKERIRFVIKKH (GTF2I L424H)
  Core: PRLERILHA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STYGIXRLXRXLHXKERIRFVIKKH

SEQ ID NO: 26306 - protein, 25 aa, Artificial Sequence
  Description of Artificial Sequence: Synthetic peptide
  Seed: STYGIPRLERILHAKERIRFVIKKH (GTF2I L424H)
  Core: ERILHAKER
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLXRIXHXKEXIRFVIKKH

SEQ ID NO: 26307 - protein, 25 aa, Artificial Sequence
  Description of Artificial Sequence: Synthetic peptide
  Seed: STYGIPRLERILHAKERIRFVIKKH (GTF2I L424H)
  Core: ILHAKERIR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLERXLHXKXRIXFVIKKH

SEQ ID NO: 26308 - protein, 25 aa, Artificial Sequence
  Description of Artificial Sequence: Synthetic peptide
  Seed: STYGIPRLERILHAKERIRFVIKKH (GTF2I L424H)
  Core: LHAKERIRF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
STYGIPRLERIXHAXEXIRXVIKKH

SEQ ID NO: 26309 - protein, 14 aa, Artificial Sequence
  Description of Artificial Sequence: Synthetic peptide
  Seed: TYGIPRLERILHAK (GTF2I L424H)
  Core: PRLERILHA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYGIXRLXRXLHXK

SEQ ID NO: 26310 - protein, 15 aa, Artificial Sequence
  Description of Artificial Sequence: Synthetic peptide
  Seed: TYGIPRLERILHAKE (GTF2I L424H)
  Core: PRLERILHA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYGIXRLXRXLHXKE

SEQ ID NO: 26311 - protein, 16 aa, Artificial Sequence
  Description of Artificial Sequence: Synthetic peptide
  Seed: TYGIPRLERILHAKER (GTF2I L424H)
  Core: PRLERILHA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYGIXRLXRXLHXKER

SEQ ID NO: 26312 - protein, 17 aa, Artificial Sequence
  Description of Artificial Sequence: Synthetic peptide
  Seed: TYGIPRLERILHAKERI (GTF2I L424H)
  Core: PRLERILHA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYGIXRLXRXLHXKERI

SEQ ID NO: 26313 - protein, 18 aa, Artificial Sequence
  Description of Artificial Sequence: Synthetic peptide
  Seed: TYGIPRLERILHAKERIR (GTF2I L424H)
  Core: PRLERILHA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYGIXRLXRXLHXKERIR

SEQ ID NO: 26314 - protein, 19 aa, Artificial Sequence
  Description of Artificial Sequence: Synthetic peptide
  Seed: TYGIPRLERILHAKERIRF (GTF2I L424H)
  Core: PRLERILHA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYGIXRLXRXLHXKERIRF

SEQ ID NO: 26315 - protein, 19 aa, Artificial Sequence
  Description of Artificial Sequence: Synthetic peptide
  Seed: TYGIPRLERILHAKERIRF (GTF2I L424H)
  Core: ILHAKERIR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLERXLHXKXRIXF

SEQ ID NO: 26316 - protein, 19 aa, Artificial Sequence
  Description of Artificial Sequence: Synthetic peptide
  Seed: TYGIPRLERILHAKERIRF (GTF2I L424H)
  Core: LHAKERIRF
  misc_feature (11)..(11): Xaa can be Cys, Phe, Ile, Leu, Met, Val, Trp, or Tyr
  misc_feature (14)..(14): Xaa can be Ala, Cys, Asp, Glu, Phe, His, Ile, Lys, Leu, Met, Asn, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLERIXHAXEXIRX

SEQ ID NO: 26317 - protein, 20 aa, Artificial Sequence
  Description of Artificial Sequence: Synthetic peptide
  Seed: TYGIPRLERILHAKERIRFV (GTF2I L424H)
  Core: PRLERILHA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYGIXRLXRXLHXKERIRFV

SEQ ID NO: 26318 - protein, 20 aa, Artificial Sequence
  Description of Artificial Sequence: Synthetic peptide
  Seed: TYGIPRLERILHAKERIRFV (GTF2I L424H)
  Core: ERILHAKER
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLXRIXHXKEXIRFV

SEQ ID NO: 26319 - protein, 20 aa, Artificial Sequence
  Description of Artificial Sequence: Synthetic peptide
  Seed: TYGIPRLERILHAKERIRFV (GTF2I L424H)
  Core: ILHAKERIR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLERXLHXKXRIXFV

SEQ ID NO: 26320 - protein, 20 aa, Artificial Sequence
  Description of Artificial Sequence: Synthetic peptide
  Seed: TYGIPRLERILHAKERIRFV (GTF2I L424H)
  Core: LHAKERIRF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLERIXHAXEXIRXV

SEQ ID NO: 26321 - protein, 21 aa, Artificial Sequence
  Description of Artificial Sequence: Synthetic peptide
  Seed: TYGIPRLERILHAKERIRFVI (GTF2I L424H)
  Core: PRLERILHA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYGIXRLXRXLHXKERIRFVI

SEQ ID NO: 26322 - protein, 21 aa, Artificial Sequence
  Description of Artificial Sequence: Synthetic peptide
  Seed: TYGIPRLERILHAKERIRFVI (GTF2I L424H)
  Core: ERILHAKER
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLXRIXHXKEXIRFVI

SEQ ID NO: 26323 - protein, 21 aa, Artificial Sequence
  Description of Artificial Sequence: Synthetic peptide
  Seed: TYGIPRLERILHAKERIRFVI (GTF2I L424H)
  Core: ILHAKERIR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLERXLHXKXRIXFVI

SEQ ID NO: 26324 - protein, 21 aa, Artificial Sequence
  Description of Artificial Sequence: Synthetic peptide
  Seed: TYGIPRLERILHAKERIRFVI (GTF2I L424H)
  Core: LHAKERIRF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLERIXHAXEXIRXVI

SEQ ID NO: 26325 - protein, 22 aa, Artificial Sequence
  Description of Artificial Sequence: Synthetic peptide
  Seed: TYGIPRLERILHAKERIRFVIK (GTF2I L424H)
  Core: PRLERILHA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYGIXRLXRXLHXKERIRFVIK

SEQ ID NO: 26326 - protein, 22 aa, Artificial Sequence
  Description of Artificial Sequence: Synthetic peptide
  Seed: TYGIPRLERILHAKERIRFVIK (GTF2I L424H)
  Core: ERILHAKER
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLXRIXHXKEXIRFVIK

SEQ ID NO: 26327 - protein, 22 aa, Artificial Sequence
  Description of Artificial Sequence: Synthetic peptide
  Seed: TYGIPRLERILHAKERIRFVIK (GTF2I L424H)
  Core: ILHAKERIR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLERXLHXKXRIXFVIK

SEQ ID NO: 26328 - protein, 22 aa, Artificial Sequence
  Description of Artificial Sequence: Synthetic peptide
  Seed: TYGIPRLERILHAKERIRFVIK (GTF2I L424H)
  Core: LHAKERIRF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLERIXHAXEXIRXVIK

SEQ ID NO: 26329 - protein, 23 aa, Artificial Sequence
  Description of Artificial Sequence: Synthetic peptide
  Seed: TYGIPRLERILHAKERIRFVIKK (GTF2I L424H)
  Core: PRLERILHA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYGIXRLXRXLHXKERIRFVIKK

SEQ ID NO: 26330 - protein, 23 aa, Artificial Sequence
  Description of Artificial Sequence: Synthetic peptide
  Seed: TYGIPRLERILHAKERIRFVIKK (GTF2I L424H)
  Core: ERILHAKER
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLXRIXHXKEXIRFVIKK

SEQ ID NO: 26331 - protein, 23 aa, Artificial Sequence
  Description of Artificial Sequence: Synthetic peptide
  Seed: TYGIPRLERILHAKERIRFVIKK (GTF2I L424H)
  Core: ILHAKERIR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLERXLHXKXRIXFVIKK

SEQ ID NO: 26332 - protein, 23 aa, Artificial Sequence
  Description of Artificial Sequence: Synthetic peptide
  Seed: TYGIPRLERILHAKERIRFVIKK (GTF2I L424H)
  Core: LHAKERIRF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLERIXHAXEXIRXVIKK

SEQ ID NO: 26333 - protein, 24 aa, Artificial Sequence
  Description of Artificial Sequence: Synthetic peptide
  Seed: TYGIPRLERILHAKERIRFVIKKH (GTF2I L424H)
  Core: PRLERILHA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYGIXRLXRXLHXKERIRFVIKKH

SEQ ID NO: 26334 - protein, 24 aa, Artificial Sequence
  Description of Artificial Sequence: Synthetic peptide
  Seed: TYGIPRLERILHAKERIRFVIKKH (GTF2I L424H)
  Core: ERILHAKER
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLXRIXHXKEXIRFVIKKH

SEQ ID NO: 26335 - protein, 24 aa, Artificial Sequence
  Description of Artificial Sequence: Synthetic peptide
  Seed: TYGIPRLERILHAKERIRFVIKKH (GTF2I L424H)
  Core: ILHAKERIR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLERXLHXKXRIXFVIKKH

SEQ ID NO: 26336 - protein, 24 aa, Artificial Sequence
  Description of Artificial Sequence: Synthetic peptide
  Seed: TYGIPRLERILHAKERIRFVIKKH (GTF2I L424H)
  Core: LHAKERIRF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLERIXHAXEXIRXVIKKH

SEQ ID NO: 26337 - protein, 25 aa, Artificial Sequence
  Description of Artificial Sequence: Synthetic peptide
  Seed: TYGIPRLERILHAKERIRFVIKKHE (GTF2I L424H)
  Core: PRLERILHA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYGIXRLXRXLHXKERIRFVIKKHE

SEQ ID NO: 26338 - protein, 25 aa, Artificial Sequence
  Description of Artificial Sequence: Synthetic peptide
  Seed: TYGIPRLERILHAKERIRFVIKKHE (GTF2I L424H)
  Core: ERILHAKER
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLXRIXHXKEXIRFVIKKHE

SEQ ID NO: 26339 - protein, 25 aa, Artificial Sequence
  Description of Artificial Sequence: Synthetic peptide
  Seed: TYGIPRLERILHAKERIRFVIKKHE (GTF2I L424H)
  Core: ILHAKERIR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLERXLHXKXRIXFVIKKHE

SEQ ID NO: 26340 - protein, 25 aa, Artificial Sequence
  Description of Artificial Sequence: Synthetic peptide
  Seed: TYGIPRLERILHAKERIRFVIKKHE (GTF2I L424H)
  Core: LHAKERIRF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TYGIPRLERIXHAXEXIRXVIKKHE

SEQ ID NO: 26341 - protein, 14 aa, Artificial Sequence
  Description of Artificial Sequence: Synthetic peptide
  Seed: YGIPRLERILHAKE (GTF2I L424H)
  Core: PRLERILHA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGIXRLXRXLHXKE

SEQ ID NO: 26342 - protein, 15 aa, Artificial Sequence
  Description of Artificial Sequence: Synthetic peptide
  Seed: YGIPRLERILHAKER (GTF2I L424H)
  Core: PRLERILHA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGIXRLXRXLHXKER

SEQ ID NO: 26343 - protein, 16 aa, Artificial Sequence
  Description of Artificial Sequence: Synthetic peptide
  Seed: YGIPRLERILHAKERI (GTF2I L424H)
  Core: PRLERILHA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGIXRLXRXLHXKERI

SEQ ID NO: 26344 - protein, 17 aa, Artificial Sequence
  Description of Artificial Sequence: Synthetic peptide
  Seed: YGIPRLERILHAKERIR (GTF2I L424H)
  Core: PRLERILHA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGIXRLXRXLHXKERIR

SEQ ID NO: 26345 - protein, 17 aa, Artificial Sequence
  Description of Artificial Sequence: Synthetic peptide
  Seed: YGIPRLERILHAKERIR (GTF2I L424H)
  Core: ERILHAKER
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLXRIXHXKEXIR

SEQ ID NO: 26346 - protein, 18 aa, Artificial Sequence
  Description of Artificial Sequence: Synthetic peptide
  Seed: YGIPRLERILHAKERIRF (GTF2I L424H)
  Core: PRLERILHA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGIXRLXRXLHXKERIRF

SEQ ID NO: 26347 - protein, 18 aa, Artificial Sequence
  Description of Artificial Sequence: Synthetic peptide
  Seed: YGIPRLERILHAKERIRF (GTF2I L424H)
  Core: ILHAKERIR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLERXLHXKXRIXF

SEQ ID NO: 26348 - protein, 19 aa, Artificial Sequence
  Description of Artificial Sequence: Synthetic peptide
  Seed: YGIPRLERILHAKERIRFV (GTF2I L424H)
  Core: PRLERILHA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGIXRLXRXLHXKERIRFV

SEQ ID NO: 26349 - protein, 19 aa, Artificial Sequence
  Description of Artificial Sequence: Synthetic peptide
  Seed: YGIPRLERILHAKERIRFV (GTF2I L424H)
  Core: ERILHAKER
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLXRIXHXKEXIRFV

SEQ ID NO: 26350 - protein, 19 aa, Artificial Sequence
  Description of Artificial Sequence: Synthetic peptide
  Seed: YGIPRLERILHAKERIRFV (GTF2I L424H)
  Core: ILHAKERIR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLERXLHXKXRIXFV

SEQ ID NO: 26351 - protein, 19 aa, Artificial Sequence
  Description of Artificial Sequence: Synthetic peptide
  Seed: YGIPRLERILHAKERIRFV (GTF2I L424H)
  Core: LHAKERIRF
  misc_feature (10)..(10): Xaa can be Ala, Cys, Asp, Glu, Phe, Gly, Ile, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLERIXHAXEXIRXV

SEQ ID NO: 26352 - protein, 20 aa, Artificial Sequence
  Description of Artificial Sequence: Synthetic peptide
  Seed: YGIPRLERILHAKERIRFVI (GTF2I L424H)
  Core: PRLERILHA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGIXRLXRXLHXKERIRFVI

SEQ ID NO: 26353 - protein, 20 aa, Artificial Sequence
  Description of Artificial Sequence: Synthetic peptide
  Seed: YGIPRLERILHAKERIRFVI (GTF2I L424H)
  Core: ERILHAKER
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLXRIXHXKEXIRFVI

SEQ ID NO: 26354 - protein, 20 aa, Artificial Sequence
  Description of Artificial Sequence: Synthetic peptide
  Seed: YGIPRLERILHAKERIRFVI (GTF2I L424H)
  Core: ILHAKERIR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLERXLHXKXRIXFVI

SEQ ID NO: 26355 - protein, 20 aa, Artificial Sequence
  Description of Artificial Sequence: Synthetic peptide
  Seed: YGIPRLERILHAKERIRFVI (GTF2I L424H)
  Core: LHAKERIRF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLERIXHAXEXIRXVI

SEQ ID NO: 26356 - protein, 21 aa, Artificial Sequence
  Description of Artificial Sequence: Synthetic peptide
  Seed: YGIPRLERILHAKERIRFVIK (GTF2I L424H)
  Core: PRLERILHA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGIXRLXRXLHXKERIRFVIK

SEQ ID NO: 26357 - protein, 21 aa, Artificial Sequence
  Description of Artificial Sequence: Synthetic peptide
  Seed: YGIPRLERILHAKERIRFVIK (GTF2I L424H)
  Core: ERILHAKER
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLXRIXHXKEXIRFVIK

SEQ ID NO: 26358 - protein, 21 aa, Artificial Sequence
  Description of Artificial Sequence: Synthetic peptide
  Seed: YGIPRLERILHAKERIRFVIK (GTF2I L424H)
  Core: ILHAKERIR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLERXLHXKXRIXFVIK

SEQ ID NO: 26359 - protein, 21 aa, Artificial Sequence
  Description of Artificial Sequence: Synthetic peptide
  Seed: YGIPRLERILHAKERIRFVIK (GTF2I L424H)
  Core: LHAKERIRF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLERIXHAXEXIRXVIK

SEQ ID NO: 26360 - protein, 22 aa, Artificial Sequence
  Description of Artificial Sequence: Synthetic peptide
  Seed: YGIPRLERILHAKERIRFVIKK (GTF2I L424H)
  Core: PRLERILHA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGIXRLXRXLHXKERIRFVIKK

SEQ ID NO: 26361 - protein, 22 aa, Artificial Sequence
  Description of Artificial Sequence: Synthetic peptide
  Seed: YGIPRLERILHAKERIRFVIKK (GTF2I L424H)
  Core: ERILHAKER
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLXRIXHXKEXIRFVIKK

SEQ ID NO: 26362 - protein, 22 aa, Artificial Sequence
  Description of Artificial Sequence: Synthetic peptide
  Seed: YGIPRLERILHAKERIRFVIKK (GTF2I L424H)
  Core: ILHAKERIR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLERXLHXKXRIXFVIKK

SEQ ID NO: 26363 - protein, 22 aa, Artificial Sequence
  Description of Artificial Sequence: Synthetic peptide
  Seed: YGIPRLERILHAKERIRFVIKK (GTF2I L424H)
  Core: LHAKERIRF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLERIXHAXEXIRXVIKK

SEQ ID NO: 26364 - protein, 23 aa, Artificial Sequence
  Description of Artificial Sequence: Synthetic peptide
  Seed: YGIPRLERILHAKERIRFVIKKH (GTF2I L424H)
  Core: PRLERILHA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGIXRLXRXLHXKERIRFVIKKH

SEQ ID NO: 26365 - protein, 23 aa, Artificial Sequence
  Description of Artificial Sequence: Synthetic peptide
  Seed: YGIPRLERILHAKERIRFVIKKH (GTF2I L424H)
  Core: ERILHAKER
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLXRIXHXKEXIRFVIKKH

SEQ ID NO: 26366 - protein, 23 aa, Artificial Sequence
  Description of Artificial Sequence: Synthetic peptide
  Seed: YGIPRLERILHAKERIRFVIKKH (GTF2I L424H)
  Core: ILHAKERIR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLERXLHXKXRIXFVIKKH

SEQ ID NO: 26367 - protein, 23 aa, Artificial Sequence
  Description of Artificial Sequence: Synthetic peptide
  Seed: YGIPRLERILHAKERIRFVIKKH (GTF2I L424H)
  Core: LHAKERIRF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLERIXHAXEXIRXVIKKH

SEQ ID NO: 26368 - protein, 24 aa, Artificial Sequence
  Description of Artificial Sequence: Synthetic peptide
  Seed: YGIPRLERILHAKERIRFVIKKHE (GTF2I L424H)
  Core: PRLERILHA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGIXRLXRXLHXKERIRFVIKKHE

SEQ ID NO: 26369 - protein, 24 aa, Artificial Sequence
  Description of Artificial Sequence: Synthetic peptide
  Seed: YGIPRLERILHAKERIRFVIKKHE (GTF2I L424H)
  Core: ERILHAKER
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLXRIXHXKEXIRFVIKKHE

SEQ ID NO: 26370 - protein, 24 aa, Artificial Sequence
  Description of Artificial Sequence: Synthetic peptide
  Seed: YGIPRLERILHAKERIRFVIKKHE (GTF2I L424H)
  Core: ILHAKERIR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLERXLHXKXRIXFVIKKHE

SEQ ID NO: 26371 - protein, 24 aa, Artificial Sequence
  Description of Artificial Sequence: Synthetic peptide
  Seed: YGIPRLERILHAKERIRFVIKKHE (GTF2I L424H)
  Core: LHAKERIRF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLERIXHAXEXIRXVIKKHE

SEQ ID NO: 26372 - protein, 25 aa, Artificial Sequence
  Description of Artificial Sequence: Synthetic peptide
  Seed: YGIPRLERILHAKERIRFVIKKHEL (GTF2I L424H)
  Core: PRLERILHA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGIXRLXRXLHXKERIRFVIKKHEL

SEQ ID NO: 26373 - protein, 25 aa, Artificial Sequence
  Description of Artificial Sequence: Synthetic peptide
  Seed: YGIPRLERILHAKERIRFVIKKHEL (GTF2I L424H)
  Core: ERILHAKER
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLXRIXHXKEXIRFVIKKHEL

SEQ ID NO: 26374 - protein, 25 aa, Artificial Sequence
  Description of Artificial Sequence: Synthetic peptide
  Seed: YGIPRLERILHAKERIRFVIKKHEL (GTF2I L424H)
  Core: ILHAKERIR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLERXLHXKXRIXFVIKKHEL

SEQ ID NO: 26375 - protein, 25 aa, Artificial Sequence
  Description of Artificial Sequence: Synthetic peptide
  Seed: YGIPRLERILHAKERIRFVIKKHEL (GTF2I L424H)
  Core: LHAKERIRF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YGIPRLERIXHAXEXIRXVIKKHEL

SEQ ID NO: 26376 - protein, 24 aa, Artificial Sequence
  Description of Artificial Sequence: Synthetic peptide
  Seed: CKNIPRLVSGWVKPIIIGCHAYGD (IDH1 R132C)
  Core: IIIGCHAYG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
CKNIPRLVSGWVKPXIIXCXAYXD

SEQ ID NO: 26377 - protein, 25 aa, Artificial Sequence
  Description of Artificial Sequence: Synthetic peptide
  Seed: CKNIPRLVSGWVKPIIIGCHAYGDQ (IDH1 R132C)
  Core: IIIGCHAYG
  misc_feature (15)..(15): Xaa can be Ala, Cys, Asp, Glu, Phe, Gly, His, Ile, Leu, Met, Asn, Pro, Gln, Ser, Thr, Val, Trp, or Ty r
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
CKNIPRLVSGWVKPXIIXCXAYXDQ

SEQ ID NO: 26378 - protein, 15 aa, Artificial Sequence
  Description of Artificial Sequence: Synthetic peptide
  Seed: GWVKPIIIGCHAYGD (IDH1 R132C)
  Core: IIIGCHAYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXCXAYXD

SEQ ID NO: 26379 - protein, 16 aa, Artificial Sequence
  Description of Artificial Sequence: Synthetic peptide
  Seed: GWVKPIIIGCHAYGDQ (IDH1 R132C)
  Core: IIIGCHAYG
  misc_feature (6)..(6): Xaa can be Phe, Ile, Leu, Met, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXCXAYXDQ

SEQ ID NO: 26380 - protein, 17 aa, Artificial Sequence
  Description of Artificial Sequence: Synthetic peptide
  Seed: GWVKPIIIGCHAYGDQY (IDH1 R132C)
  Core: IIIGCHAYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXCXAYXDQY

SEQ ID NO: 26381 - protein, 19 aa, Artificial Sequence
  Description of Artificial Sequence: Synthetic peptide
  Seed: GWVKPIIIGCHAYGDQYRA (IDH1 R132C)
  Core: IIIGCHAYG
  misc_feature (6)..(6): Xaa can be Phe, Ile, Leu, Met, Val, Trp, or Tyr
  misc_feature (9)..(9): Xaa can be Ala, Cys, Asp, Glu, Phe, Gly, His, Ile, Lys, Leu, Met, Asn, Gln, Ser, Thr, Val, or Trp
  misc_feature (11)..(11): Xaa can be Ala, Cys, Asp, Glu, Gly, His, Ile, Lys, Leu, Met, Asn, Pro, Gln, Arg, Ser, Thr, Val, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXCXAYXDQYRA

SEQ ID NO: 26382 - protein, 20 aa, Artificial Sequence
  Description of Artificial Sequence: Synthetic peptide
  Seed: GWVKPIIIGCHAYGDQYRAT (IDH1 R132C)
  Core: IIIGCHAYG
  misc_feature (6)..(6): Xaa can be Ala, Cys, Phe, His, Ile, Lys, Leu, Met, Gln, Arg, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXCXAYXDQYRAT

SEQ ID NO: 26383 - protein, 21 aa, Artificial Sequence
  Description of Artificial Sequence: Synthetic peptide
  Seed: GWVKPIIIGCHAYGDQYRATD (IDH1 R132C)
  Core: IIIGCHAYG
  misc_feature (6)..(6): Xaa can be Phe, Ile, Leu, Met, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, or Tr p
  misc_feature (11)..(11): Xaa can be Ala, Cys, Asp, Glu, Gly, His, Ile, Lys, Leu, Met, Asn, Pro, Gln, Arg, Ser, Thr, Val, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXCXAYXDQYRATD

SEQ ID NO: 26384 - protein, 22 aa, Artificial Sequence
  Description of Artificial Sequence: Synthetic peptide
  Seed: GWVKPIIIGCHAYGDQYRATDF (IDH1 R132C)
  Core: IIIGCHAYG
  misc_feature (6)..(6): Xaa can be Phe, Ile, Leu, Met, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, or Tr p
  misc_feature (11)..(11): Xaa can be Ala, Cys, Asp, Glu, Gly, His, Ile, Lys, Leu, Met, Asn, Pro, Gln, Arg, Ser, Thr, Val, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXCXAYXDQYRATDF

SEQ ID NO: 26385 - protein, 23 aa, Artificial Sequence
  Description of Artificial Sequence: Synthetic peptide
  Seed: GWVKPIIIGCHAYGDQYRATDFV (IDH1 R132C)
  Core: IIIGCHAYG
  misc_feature (6)..(6): Xaa can be Phe, Ile, Leu, Met, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, or Tr p
  misc_feature (11)..(11): Xaa can be Ala, Cys, Asp, Glu, Gly, His, Ile, Lys, Leu, Met, Asn, Pro, Gln, Arg, Ser, Thr, Val, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXCXAYXDQYRATDFV

SEQ ID NO: 26386 - protein, 24 aa, Artificial Sequence
  Description of Artificial Sequence: Synthetic peptide
  Seed: GWVKPIIIGCHAYGDQYRATDFVV (IDH1 R132C)
  Core: IIIGCHAYG
  misc_feature (6)..(6): Xaa can be Phe, Ile, Leu, Met, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, or Tr p
  misc_feature (11)..(11): Xaa can be Ala, Cys, Asp, Glu, Gly, His, Ile, Lys, Leu, Met, Asn, Pro, Gln, Arg, Ser, Thr, Val, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXCXAYXDQYRATDFVV

SEQ ID NO: 26387 - protein, 25 aa, Artificial Sequence
  Description of Artificial Sequence: Synthetic peptide
  Seed: GWVKPIIIGCHAYGDQYRATDFVVP (IDH1 R132C)
  Core: IIIGCHAYG
  misc_feature (6)..(6): Xaa can be Phe, Ile, Leu, Met, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, or Tr p
  misc_feature (11)..(11): Xaa can be Ala, Cys, Asp, Glu, Gly, His, Ile, Lys, Leu, Met, Asn, Pro, Gln, Arg, Ser, Thr, Val, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXCXAYXDQYRATDFVVP

SEQ ID NO: 26388 - protein, 25 aa, Artificial Sequence
  Description of Artificial Sequence: Synthetic peptide
  Seed: ICKNIPRLVSGWVKPIIIGCHAYGD (IDH1 R132C)
  Core: IIIGCHAYG
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
ICKNIPRLVSGWVKPXIIXCXAYXD

SEQ ID NO: 26389 - protein, 25 aa, Artificial Sequence
  Description of Artificial Sequence: Synthetic peptide
  Seed: IICKNIPRLVSGWVKPIIIGCHAYG (IDH1 R132C)
  Core: VKPIIIGCH
  misc_feature (14)..(14): Xaa can be Phe, Ile, Leu, Met, Val, Trp, or Tyr
  misc_feature (17)..(17): Xaa can be Ala, Glu, Phe, His, Ile, Lys, Leu, Met, Asn, Gln, Arg, Ser, Thr, Val, Trp, or Tyr
  misc_feature (19)..(19): Xaa can be Ala, Glu, Phe, Gly, His, Ile, Lys, Leu, Met, Asn, Pro, Gln, Arg, Ser, Thr, Val, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IICKNIPRLVSGWXKPXIXGCXAYG

SEQ ID NO: 26390 - protein, 20 aa, Artificial Sequence
  Description of Artificial Sequence: Synthetic peptide
  Seed: IPRLVSGWVKPIIIGCHAYG (IDH1 R132C)
  Core: VKPIIIGCH
  misc_feature (9)..(9): Xaa can be Ala, Cys, Phe, His, Ile, Leu, Met, Asn, Gln, Ser, Thr, Val, Trp, or Tyr
  misc_feature (12)..(12): Xaa can be Ala, Cys, Glu, Phe, Gly, His, Ile, Lys, Leu, Met, Asn, Gln, Arg, Ser, Thr, Val, Trp, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IPRLVSGWXKPXIXGCXAYG

SEQ ID NO: 26391 - protein, 21 aa, Artificial Sequence
  Description of Artificial Sequence: Synthetic peptide
  Seed: IPRLVSGWVKPIIIGCHAYGD (IDH1 R132C)
  Core: IIIGCHAYG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IPRLVSGWVKPXIIXCXAYXD

SEQ ID NO: 26392 - protein, 22 aa, Artificial Sequence
  Description of Artificial Sequence: Synthetic peptide
  Seed: IPRLVSGWVKPIIIGCHAYGDQ (IDH1 R132C)
  Core: IIIGCHAYG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IPRLVSGWVKPXIIXCXAYXDQ

SEQ ID NO: 26393 - protein, 23 aa, Artificial Sequence
  Description of Artificial Sequence: Synthetic peptide
  Seed: IPRLVSGWVKPIIIGCHAYGDQY (IDH1 R132C)
  Core: IIIGCHAYG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IPRLVSGWVKPXIIXCXAYXDQY

SEQ ID NO: 26394 - protein, 24 aa, Artificial Sequence
  Description of Artificial Sequence: Synthetic peptide
  Seed: IPRLVSGWVKPIIIGCHAYGDQYR (IDH1 R132C)
  Core: IIIGCHAYG
  misc_feature (12)..(12): Xaa can be Ala, Cys, Asp, Glu, Phe, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IPRLVSGWVKPXIIXCXAYXDQYR

SEQ ID NO: 26395 - protein, 25 aa, Artificial Sequence
  Description of Artificial Sequence: Synthetic peptide
  Seed: IPRLVSGWVKPIIIGCHAYGDQYRA (IDH1 R132C)
  Core: IIIGCHAYG
  misc_feature (12)..(12): Xaa can be Ala, Cys, Phe, His, Ile, Leu, Met, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IPRLVSGWVKPXIIXCXAYXDQYRA

SEQ ID NO: 26396 - protein, 23 aa, Artificial Sequence
  Description of Artificial Sequence: Synthetic peptide
  Seed: KNIPRLVSGWVKPIIIGCHAYGD (IDH1 R132C)
  Core: IIIGCHAYG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KNIPRLVSGWVKPXIIXCXAYXD

SEQ ID NO: 26397 - protein, 24 aa, Artificial Sequence
  Description of Artificial Sequence: Synthetic peptide
  Seed: KNIPRLVSGWVKPIIIGCHAYGDQ (IDH1 R132C)
  Core: IIIGCHAYG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KNIPRLVSGWVKPXIIXCXAYXDQ

SEQ ID NO: 26398 - protein, 25 aa, Artificial Sequence
  Description of Artificial Sequence: Synthetic peptide
  Seed: KNIPRLVSGWVKPIIIGCHAYGDQY (IDH1 R132C)
  Core: IIIGCHAYG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KNIPRLVSGWVKPXIIXCXAYXDQY

SEQ ID NO: 26399 - protein, 15 aa, Artificial Sequence
  Description of Artificial Sequence: Synthetic peptide
  Seed: KPIIIGCHAYGDQYR (IDH1 R132C)
  Core: IIIGCHAYG
  misc_feature (3)..(3): Xaa can be Phe, Ile, Leu, Met, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Gly, His, Ile, Lys, Leu, Asn, Pro, Gln, Arg, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KPXIIXCXAYXDQYR

SEQ ID NO: 26400 - protein, 14 aa, Artificial Sequence
  Description of Artificial Sequence: Synthetic peptide
  Seed: LVSGWVKPIIIGCH (IDH1 R132C)
  Core: VKPIIIGCH
  misc_feature (6)..(6): Xaa can be Ala, Cys, Phe, His, Ile, Leu, Met, Asn, Thr, Val, Trp, or Tyr
  misc_feature (9)..(9): Xaa can be Ala, Cys, Phe, Gly, Ile, Leu, Met, Asn, Ser, Thr, or Val
  misc_feature (11)..(11): Xaa can be Ala, Cys, Asp, Glu, Phe, Gly, His, Ile, Leu, Met, Asn, Pro, Gln, Ser, Thr, Val, or Trp
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWXKPXIXGCX

SEQ ID NO: 26401 - protein, 15 aa, Artificial Sequence
  Description of Artificial Sequence: Synthetic peptide
  Seed: LVSGWVKPIIIGCHA (IDH1 R132C)
  Core: VKPIIIGCH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWXKPXIXGCXA

SEQ ID NO: 26402 - protein, 16 aa, Artificial Sequence
  Description of Artificial Sequence: Synthetic peptide
  Seed: LVSGWVKPIIIGCHAY (IDH1 R132C)
  Core: VKPIIIGCH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWXKPXIXGCXAY

SEQ ID NO: 26403 - protein, 17 aa, Artificial Sequence
  Description of Artificial Sequence: Synthetic peptide
  Seed: LVSGWVKPIIIGCHAYG (IDH1 R132C)
  Core: VKPIIIGCH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWXKPXIXGCXAYG

SEQ ID NO: 26404 - protein, 17 aa, Artificial Sequence
  Description of Artificial Sequence: Synthetic peptide
  Seed: LVSGWVKPIIIGCHAYG (IDH1 R132C)
  Core: IIIGCHAYG
  misc_feature (9)..(9): Xaa can be Phe, Ile, Leu, Met, Arg, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Gly, His, Ile, Lys, Leu, Met, Asn, Pro, Gln, Arg, Ser, Thr, Val, or Tr p
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWVKPXIIXCXAYX

SEQ ID NO: 26405 - protein, 19 aa, Artificial Sequence
  Description of Artificial Sequence: Synthetic peptide
  Seed: LVSGWVKPIIIGCHAYGDQ (IDH1 R132C)
  Core: IIIGCHAYG
  misc_feature (9)..(9): Xaa can be Phe, Ile, Leu, Met, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWVKPXIIXCXAYXDQ

SEQ ID NO: 26406 - protein, 20 aa, Artificial Sequence
  Description of Artificial Sequence: Synthetic peptide
  Seed: LVSGWVKPIIIGCHAYGDQY (IDH1 R132C)
  Core: IIIGCHAYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWVKPXIIXCXAYXDQY

SEQ ID NO: 26407 - protein, 21 aa, Artificial Sequence
  Description of Artificial Sequence: Synthetic peptide
  Seed: LVSGWVKPIIIGCHAYGDQYR (IDH1 R132C)
  Core: IIIGCHAYG
  misc_feature (9)..(9): Xaa can be Ala, Cys, Phe, Ile, Lys, Leu, Met, Gln, Arg, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWVKPXIIXCXAYXDQYR

SEQ ID NO: 26408 - protein, 22 aa, Artificial Sequence
  Description of Artificial Sequence: Synthetic peptide
  Seed: LVSGWVKPIIIGCHAYGDQYRA (IDH1 R132C)
  Core: IIIGCHAYG
  misc_feature (9)..(9): Xaa can be Ala, Cys, Phe, Ile, Lys, Leu, Met, Gln, Arg, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWVKPXIIXCXAYXDQYRA

SEQ ID NO: 26409 - protein, 23 aa, Artificial Sequence
  Description of Artificial Sequence: Synthetic peptide
  Seed: LVSGWVKPIIIGCHAYGDQYRAT (IDH1 R132C)
  Core: IIIGCHAYG
  misc_feature (9)..(9): Xaa can be Ala, Cys, Phe, Ile, Lys, Leu, Met, Gln, Arg, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWVKPXIIXCXAYXDQYRAT

SEQ ID NO: 26410 - protein, 24 aa, Artificial Sequence
  Description of Artificial Sequence: Synthetic peptide
  Seed: LVSGWVKPIIIGCHAYGDQYRATD (IDH1 R132C)
  Core: IIIGCHAYG
  misc_feature (9)..(9): Xaa can be Ala, Cys, Phe, Ile, Lys, Leu, Met, Gln, Arg, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWVKPXIIXCXAYXDQYRATD

SEQ ID NO: 26411 - protein, 25 aa, Artificial Sequence
  Description of Artificial Sequence: Synthetic peptide
  Seed: LVSGWVKPIIIGCHAYGDQYRATDF (IDH1 R132C)
  Core: IIIGCHAYG
  misc_feature (9)..(9): Xaa can be Ala, Cys, Phe, Ile, Lys, Leu, Met, Gln, Arg, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWVKPXIIXCXAYXDQYRATDF

SEQ ID NO: 26412 - protein, 22 aa, Artificial Sequence
  Description of Artificial Sequence: Synthetic peptide
  Seed: NIPRLVSGWVKPIIIGCHAYGD (IDH1 R132C)
  Core: IIIGCHAYG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NIPRLVSGWVKPXIIXCXAYXD

SEQ ID NO: 26413 - protein, 23 aa, Artificial Sequence
  Description of Artificial Sequence: Synthetic peptide
  Seed: NIPRLVSGWVKPIIIGCHAYGDQ (IDH1 R132C)
  Core: IIIGCHAYG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NIPRLVSGWVKPXIIXCXAYXDQ

SEQ ID NO: 26414 - protein, 24 aa, Artificial Sequence
  Description of Artificial Sequence: Synthetic peptide
  Seed: NIPRLVSGWVKPIIIGCHAYGDQY (IDH1 R132C)
  Core: IIIGCHAYG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NIPRLVSGWVKPXIIXCXAYXDQY

SEQ ID NO: 26415 - protein, 25 aa, Artificial Sequence
  Description of Artificial Sequence: Synthetic peptide
  Seed: NIPRLVSGWVKPIIIGCHAYGDQYR (IDH1 R132C)
  Core: IIIGCHAYG
  misc_feature (13)..(13): Xaa can be Ala, Cys, Asp, Glu, Phe, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NIPRLVSGWVKPXIIXCXAYXDQYR

SEQ ID NO: 26416 - protein, 19 aa, Artificial Sequence
  Description of Artificial Sequence: Synthetic peptide
  Seed: PRLVSGWVKPIIIGCHAYG (IDH1 R132C)
  Core: VKPIIIGCH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Phe, Gly, His, Ile, Leu, Met, Asn, Gln, Ser, Thr, Val, Trp, or Tyr
  misc_feature (13)..(13): Xaa can be Ala, Cys, Asp, Glu, Phe, Gly, His, Ile, Leu, Met, Asn, Pro, Ser, Thr, or Val
  misc_feature (16)..(16): Xaa can be Ala, Cys, Asp, Glu, Phe, Gly, His, Ile, Lys, Leu, Met, Asn, Pro, Gln, Arg, Ser, Thr, Val, or Tyr
PRLVSGWXKPXIXGCXAYG

SEQ ID NO: 26417 - protein, 20 aa, Artificial Sequence
  Description of Artificial Sequence: Synthetic peptide
  Seed: PRLVSGWVKPIIIGCHAYGD (IDH1 R132C)
  Core: VKPIIIGCH
  misc_feature (8)..(8): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWXKPXIXGCXAYGD

SEQ ID NO: 26418 - protein, 20 aa, Artificial Sequence
  Description of Artificial Sequence: Synthetic peptide
  Seed: PRLVSGWVKPIIIGCHAYGD (IDH1 R132C)
  Core: IIIGCHAYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWVKPXIIXCXAYXD

SEQ ID NO: 26419 - protein, 21 aa, Artificial Sequence
  Description of Artificial Sequence: Synthetic peptide
  Seed: PRLVSGWVKPIIIGCHAYGDQ (IDH1 R132C)
  Core: IIIGCHAYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWVKPXIIXCXAYXDQ

SEQ ID NO: 26420 - protein, 22 aa, Artificial Sequence
  Description of Artificial Sequence: Synthetic peptide
  Seed: PRLVSGWVKPIIIGCHAYGDQY (IDH1 R132C)
  Core: IIIGCHAYG
  misc_feature (11)..(11): Xaa can be Ala, Cys, Asp, Glu, Phe, Gly, His, Ile, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWVKPXIIXCXAYXDQY

SEQ ID NO: 26421 - protein, 23 aa, Artificial Sequence
  Description of Artificial Sequence: Synthetic peptide
  Seed: PRLVSGWVKPIIIGCHAYGDQYR (IDH1 R132C)
  Core: IIIGCHAYG
  misc_feature (11)..(11): Xaa can be Ala, Cys, Phe, His, Ile, Leu, Met, Gln, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWVKPXIIXCXAYXDQYR

SEQ ID NO: 26422 - protein, 24 aa, Artificial Sequence
  Description of Artificial Sequence: Synthetic peptide
  Seed: PRLVSGWVKPIIIGCHAYGDQYRA (IDH1 R132C)
  Core: IIIGCHAYG
  misc_feature (11)..(11): Xaa can be Ala, Cys, Phe, His, Ile, Leu, Met, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWVKPXIIXCXAYXDQYRA

SEQ ID NO: 26423 - protein, 25 aa, Artificial Sequence
  Description of Artificial Sequence: Synthetic peptide
  Seed: PRLVSGWVKPIIIGCHAYGDQYRAT (IDH1 R132C)
  Core: IIIGCHAYG
  misc_feature (11)..(11): Xaa can be Ala, Cys, Phe, His, Ile, Leu, Met, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWVKPXIIXCXAYXDQYRAT

SEQ ID NO: 26424 - protein, 16 aa, Artificial Sequence
  Description of Artificial Sequence: Synthetic peptide
  Seed: RLVSGWVKPIIIGCHA (IDH1 R132C)
  Core: VKPIIIGCH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Glu, Phe, Gly, His, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Ser, Thr, Val, Trp, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWXKPXIXGCXA

SEQ ID NO: 26425 - protein, 17 aa, Artificial Sequence
  Description of Artificial Sequence: Synthetic peptide
  Seed: RLVSGWVKPIIIGCHAY (IDH1 R132C)
  Core: VKPIIIGCH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWXKPXIXGCXAY

SEQ ID NO: 26426 - protein, 18 aa, Artificial Sequence
  Description of Artificial Sequence: Synthetic peptide
  Seed: RLVSGWVKPIIIGCHAYG (IDH1 R132C)
  Core: VKPIIIGCH
  misc_feature (7)..(7): Xaa can be Ala, Cys, Asp, Glu, Phe, Gly, His, Ile, Leu, Met, Asn, Pro, Gln, Ser, Thr, Val, Trp, or Ty r
  misc_feature (10)..(10): Xaa can be Ala, Cys, Phe, Gly, His, Ile, Leu, Met, Asn, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWXKPXIXGCXAYG

SEQ ID NO: 26427 - protein, 19 aa, Artificial Sequence
  Description of Artificial Sequence: Synthetic peptide
  Seed: RLVSGWVKPIIIGCHAYGD (IDH1 R132C)
  Core: VKPIIIGCH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Leu, Met, Asn, Gln, Ser, Thr, Val, Trp, or Tyr
  misc_feature (12)..(12): Xaa can be Ala, Cys, Asp, Glu, Phe, Gly, Ile, Leu, Met, Asn, Pro, Ser, Thr, or Val
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWXKPXIXGCXAYGD

SEQ ID NO: 26428 - protein, 19 aa, Artificial Sequence
  Description of Artificial Sequence: Synthetic peptide
  Seed: RLVSGWVKPIIIGCHAYGD (IDH1 R132C)
  Core: IIIGCHAYG
  misc_feature (10)..(10): Xaa can be Ala, Cys, Phe, His, Ile, Leu, Met, Gln, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWVKPXIIXCXAYXD

SEQ ID NO: 26429 - protein, 20 aa, Artificial Sequence
  Description of Artificial Sequence: Synthetic peptide
  Seed: RLVSGWVKPIIIGCHAYGDQ (IDH1 R132C)
  Core: IIIGCHAYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWVKPXIIXCXAYXDQ

SEQ ID NO: 26430 - protein, 21 aa, Artificial Sequence
  Description of Artificial Sequence: Synthetic peptide
  Seed: RLVSGWVKPIIIGCHAYGDQY (IDH1 R132C)
  Core: IIIGCHAYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWVKPXIIXCXAYXDQY

SEQ ID NO: 26431 - protein, 22 aa, Artificial Sequence
  Description of Artificial Sequence: Synthetic peptide
  Seed: RLVSGWVKPIIIGCHAYGDQYR (IDH1 R132C)
  Core: IIIGCHAYG
  misc_feature (10)..(10): Xaa can be Ala, Cys, Phe, His, Ile, Lys, Leu, Met, Gln, Arg, Thr, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWVKPXIIXCXAYXDQYR

SEQ ID NO: 26432 - protein, 23 aa, Artificial Sequence
  Description of Artificial Sequence: Synthetic peptide
  Seed: RLVSGWVKPIIIGCHAYGDQYRA (IDH1 R132C)
  Core: IIIGCHAYG
  misc_feature (10)..(10): Xaa can be Ala, Cys, Phe, His, Ile, Lys, Leu, Met, Gln, Arg, Thr, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWVKPXIIXCXAYXDQYRA

SEQ ID NO: 26433 - protein, 24 aa, Artificial Sequence
  Description of Artificial Sequence: Synthetic peptide
  Seed: RLVSGWVKPIIIGCHAYGDQYRAT (IDH1 R132C)
  Core: IIIGCHAYG
  misc_feature (10)..(10): Xaa can be Ala, Cys, Phe, His, Ile, Lys, Leu, Met, Gln, Arg, Thr, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWVKPXIIXCXAYXDQYRAT

SEQ ID NO: 26434 - protein, 25 aa, Artificial Sequence
  Description of Artificial Sequence: Synthetic peptide
  Seed: RLVSGWVKPIIIGCHAYGDQYRATD (IDH1 R132C)
  Core: IIIGCHAYG
  misc_feature (10)..(10): Xaa can be Ala, Cys, Phe, His, Ile, Lys, Leu, Met, Gln, Arg, Thr, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWVKPXIIXCXAYXDQYRATD

SEQ ID NO: 26435 - protein, 15 aa, Artificial Sequence
  Description of Artificial Sequence: Synthetic peptide
  Seed: SGWVKPIIIGCHAYG (IDH1 R132C)
  Core: VKPIIIGCH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGWXKPXIXGCXAYG

SEQ ID NO: 26436 - protein, 15 aa, Artificial Sequence
  Description of Artificial Sequence: Synthetic peptide
  Seed: SGWVKPIIIGCHAYG (IDH1 R132C)
  Core: IIIGCHAYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXCXAYX

SEQ ID NO: 26437 - protein, 16 aa, Artificial Sequence
  Description of Artificial Sequence: Synthetic peptide
  Seed: SGWVKPIIIGCHAYGD (IDH1 R132C)
  Core: IIIGCHAYG
  misc_feature (7)..(7): Xaa can be Ala, Cys, Glu, Phe, Gly, His, Ile, Lys, Leu, Met, Gln, Arg, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXCXAYXD

SEQ ID NO: 26438 - protein, 17 aa, Artificial Sequence
  Description of Artificial Sequence: Synthetic peptide
  Seed: SGWVKPIIIGCHAYGDQ (IDH1 R132C)
  Core: IIIGCHAYG
  misc_feature (7)..(7): Xaa can be Ala, Cys, Asp, Glu, Phe, Gly, His, Ile, Leu, Met, Asn, Pro, Gln, Ser, Thr, Val, Trp, or Ty r
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXCXAYXDQ

SEQ ID NO: 26439 - protein, 19 aa, Artificial Sequence
  Description of Artificial Sequence: Synthetic peptide
  Seed: SGWVKPIIIGCHAYGDQYR (IDH1 R132C)
  Core: IIIGCHAYG
  misc_feature (7)..(7): Xaa can be Phe, Ile, Leu, Met, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Gly, His, Ile, Lys, Leu, Met, Asn, Pro, Gln, Arg, Ser, Thr, Val, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXCXAYXDQYR

SEQ ID NO: 26440 - protein, 20 aa, Artificial Sequence
  Description of Artificial Sequence: Synthetic peptide
  Seed: SGWVKPIIIGCHAYGDQYRA (IDH1 R132C)
  Core: IIIGCHAYG
  misc_feature (7)..(7): Xaa can be Ala, Cys, Phe, Ile, Lys, Leu, Met, Gln, Arg, Thr, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXCXAYXDQYRA

SEQ ID NO: 26441 - protein, 21 aa, Artificial Sequence
  Description of Artificial Sequence: Synthetic peptide
  Seed: SGWVKPIIIGCHAYGDQYRAT (IDH1 R132C)
  Core: IIIGCHAYG
  misc_feature (7)..(7): Xaa can be Phe, Ile, Leu, Met, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXCXAYXDQYRAT

SEQ ID NO: 26442 - protein, 22 aa, Artificial Sequence
  Description of Artificial Sequence: Synthetic peptide
  Seed: SGWVKPIIIGCHAYGDQYRATD (IDH1 R132C)
  Core: IIIGCHAYG
  misc_feature (7)..(7): Xaa can be Phe, Ile, Leu, Met, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Gly, His, Ile, Lys, Leu, Met, Asn, Pro, Gln, Arg, Ser, Thr, Val, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXCXAYXDQYRATD

SEQ ID NO: 26443 - protein, 23 aa, Artificial Sequence
  Description of Artificial Sequence: Synthetic peptide
  Seed: SGWVKPIIIGCHAYGDQYRATDF (IDH1 R132C)
  Core: IIIGCHAYG
  misc_feature (7)..(7): Xaa can be Phe, Ile, Leu, Met, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Gly, His, Ile, Lys, Leu, Met, Asn, Pro, Gln, Arg, Ser, Thr, Val, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXCXAYXDQYRATDF

SEQ ID NO: 26444 - protein, 24 aa, Artificial Sequence
  Description of Artificial Sequence: Synthetic peptide
  Seed: SGWVKPIIIGCHAYGDQYRATDFV (IDH1 R132C)
  Core: IIIGCHAYG
  misc_feature (7)..(7): Xaa can be Phe, Ile, Leu, Met, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Gly, His, Ile, Lys, Leu, Met, Asn, Pro, Gln, Arg, Ser, Thr, Val, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXCXAYXDQYRATDFV

SEQ ID NO: 26445 - protein, 25 aa, Artificial Sequence
  Description of Artificial Sequence: Synthetic peptide
  Seed: SGWVKPIIIGCHAYGDQYRATDFVV (IDH1 R132C)
  Core: IIIGCHAYG
  misc_feature (7)..(7): Xaa can be Phe, Ile, Leu, Met, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Gly, His, Ile, Lys, Leu, Met, Asn, Pro, Gln, Arg, Ser, Thr, Val, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXCXAYXDQYRATDFVV

SEQ ID NO: 26446 - protein, 15 aa, Artificial Sequence
  Description of Artificial Sequence: Synthetic peptide
  Seed: VKPIIIGCHAYGDQY (IDH1 R132C)
  Core: IIIGCHAYG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKPXIIXCXAYXDQY

SEQ ID NO: 26447 - protein, 16 aa, Artificial Sequence
  Description of Artificial Sequence: Synthetic peptide
  Seed: VKPIIIGCHAYGDQYR (IDH1 R132C)
  Core: IIIGCHAYG
  misc_feature (4)..(4): Xaa can be Phe, Ile, Leu, Met, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Gly, His, Ile, Lys, Leu, Met, Asn, Pro, Gln, Arg, Ser, Thr, Val, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKPXIIXCXAYXDQYR

SEQ ID NO: 26448 - protein, 17 aa, Artificial Sequence
  Description of Artificial Sequence: Synthetic peptide
  Seed: VKPIIIGCHAYGDQYRA (IDH1 R132C)
  Core: IIIGCHAYG
  misc_feature (4)..(4): Xaa can be Phe, Ile, Leu, Met, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Gly, His, Ile, Lys, Leu, Met, Asn, Pro, Gln, Arg, Ser, Thr, Val, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKPXIIXCXAYXDQYRA

SEQ ID NO: 26449 - protein, 15 aa, Artificial Sequence
  Description of Artificial Sequence: Synthetic peptide
  Seed: VSGWVKPIIIGCHAY (IDH1 R132C)
  Core: VKPIIIGCH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSGWXKPXIXGCXAY

SEQ ID NO: 26450 - protein, 16 aa, Artificial Sequence
  Description of Artificial Sequence: Synthetic peptide
  Seed: VSGWVKPIIIGCHAYG (IDH1 R132C)
  Core: VKPIIIGCH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSGWXKPXIXGCXAYG

SEQ ID NO: 26451 - protein, 17 aa, Artificial Sequence
  Description of Artificial Sequence: Synthetic peptide
  Seed: VSGWVKPIIIGCHAYGD (IDH1 R132C)
  Core: IIIGCHAYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXCXAYXD

SEQ ID NO: 26452 - protein, 19 aa, Artificial Sequence
  Description of Artificial Sequence: Synthetic peptide
  Seed: VSGWVKPIIIGCHAYGDQY (IDH1 R132C)
  Core: IIIGCHAYG
  misc_feature (8)..(8): Xaa can be Phe, Ile, Leu, Met, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXCXAYXDQY

SEQ ID NO: 26453 - protein, 20 aa, Artificial Sequence
  Description of Artificial Sequence: Synthetic peptide
  Seed: VSGWVKPIIIGCHAYGDQYR (IDH1 R132C)
  Core: IIIGCHAYG
  misc_feature (8)..(8): Xaa can be Ala, Cys, Phe, Ile, Lys, Leu, Met, Gln, Arg, Thr, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXCXAYXDQYR

SEQ ID NO: 26454 - protein, 21 aa, Artificial Sequence
  Description of Artificial Sequence: Synthetic peptide
  Seed: VSGWVKPIIIGCHAYGDQYRA (IDH1 R132C)
  Core: IIIGCHAYG
  misc_feature (8)..(8): Xaa can be Phe, Ile, Leu, Met, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXCXAYXDQYRA

SEQ ID NO: 26455 - protein, 22 aa, Artificial Sequence
  Description of Artificial Sequence: Synthetic peptide
  Seed: VSGWVKPIIIGCHAYGDQYRAT (IDH1 R132C)
  Core: IIIGCHAYG
  misc_feature (8)..(8): Xaa can be Phe, Ile, Leu, Met, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXCXAYXDQYRAT

SEQ ID NO: 26456 - protein, 23 aa, Artificial Sequence
  Description of Artificial Sequence: Synthetic peptide
  Seed: VSGWVKPIIIGCHAYGDQYRATD (IDH1 R132C)
  Core: IIIGCHAYG
  misc_feature (8)..(8): Xaa can be Phe, Ile, Leu, Met, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Gly, His, Ile, Lys, Leu, Met, Asn, Pro, Gln, Arg, Ser, Thr, Val, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXCXAYXDQYRATD

SEQ ID NO: 26457 - protein, 24 aa, Artificial Sequence
  Description of Artificial Sequence: Synthetic peptide
  Seed: VSGWVKPIIIGCHAYGDQYRATDF (IDH1 R132C)
  Core: IIIGCHAYG
  misc_feature (8)..(8): Xaa can be Ala, Cys, Phe, Ile, Lys, Leu, Met, Gln, Arg, Thr, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXCXAYXDQYRATDF

SEQ ID NO: 26458 - protein, 25 aa, Artificial Sequence
  Description of Artificial Sequence: Synthetic peptide
  Seed: VSGWVKPIIIGCHAYGDQYRATDFV (IDH1 R132C)
  Core: IIIGCHAYG
  misc_feature (8)..(8): Xaa can be Ala, Cys, Phe, Ile, Lys, Leu, Met, Gln, Arg, Thr, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXCXAYXDQYRATDFV

SEQ ID NO: 26459 - protein, 15 aa, Artificial Sequence
  Description of Artificial Sequence: Synthetic peptide
  Seed: WVKPIIIGCHAYGDQ (IDH1 R132C)
  Core: IIIGCHAYG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXCXAYXDQ

SEQ ID NO: 26460 - protein, 16 aa, Artificial Sequence
  Description of Artificial Sequence: Synthetic peptide
  Seed: WVKPIIIGCHAYGDQY (IDH1 R132C)
  Core: IIIGCHAYG
  misc_feature (5)..(5): Xaa can be Ala, Cys, Phe, His, Ile, Leu, Met, Asn, Gln, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXCXAYXDQY

SEQ ID NO: 26461 - protein, 17 aa, Artificial Sequence
  Description of Artificial Sequence: Synthetic peptide
  Seed: WVKPIIIGCHAYGDQYR (IDH1 R132C)
  Core: IIIGCHAYG
  misc_feature (5)..(5): Xaa can be Ala, Cys, Phe, His, Ile, Leu, Met, Gln, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXCXAYXDQYR

SEQ ID NO: 26462 - protein, 19 aa, Artificial Sequence
  Description of Artificial Sequence: Synthetic peptide
  Seed: WVKPIIIGCHAYGDQYRAT (IDH1 R132C)
  Core: IIIGCHAYG
  misc_feature (5)..(5): Xaa can be Phe, Ile, Leu, Met, Val, Trp, or Tyr
  misc_feature (8)..(8): Xaa can be Ala, Cys, Asp, Glu, Phe, Gly, His, Ile, Lys, Leu, Met, Asn, Gln, Ser, Thr, Val, or Trp
  misc_feature (10)..(10): Xaa can be Ala, Cys, Asp, Glu, Gly, His, Ile, Lys, Leu, Met, Asn, Pro, Gln, Arg, Ser, Thr, Val, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXCXAYXDQYRAT

SEQ ID NO: 26463 - protein, 20 aa, Artificial Sequence
  Description of Artificial Sequence: Synthetic peptide
  Seed: WVKPIIIGCHAYGDQYRATD (IDH1 R132C)
  Core: IIIGCHAYG
  misc_feature (5)..(5): Xaa can be Phe, Ile, Leu, Met, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Gly, His, Ile, Lys, Leu, Met, Asn, Pro, Gln, Arg, Ser, Thr, Val, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXCXAYXDQYRATD

SEQ ID NO: 26464 - protein, 21 aa, Artificial Sequence
  Description of Artificial Sequence: Synthetic peptide
  Seed: WVKPIIIGCHAYGDQYRATDF (IDH1 R132C)
  Core: IIIGCHAYG
  misc_feature (5)..(5): Xaa can be Phe, Ile, Leu, Met, Val, Trp, or Tyr
  misc_feature (8)..(8): Xaa can be Ala, Cys, Asp, Glu, Gly, His, Ile, Lys, Leu, Met, Asn, Gln, Arg, Ser, Thr, Val, or Trp
  misc_feature (10)..(10): Xaa can be Ala, Cys, Asp, Glu, Gly, His, Ile, Lys, Leu, Met, Asn, Pro, Gln, Arg, Ser, Thr, Val, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXCXAYXDQYRATDF

SEQ ID NO: 26465 - protein, 22 aa, Artificial Sequence
  Description of Artificial Sequence: Synthetic peptide
  Seed: WVKPIIIGCHAYGDQYRATDFV (IDH1 R132C)
  Core: IIIGCHAYG
  misc_feature (5)..(5): Xaa can be Phe, Ile, Leu, Met, Val, Trp, or Tyr
  misc_feature (8)..(8): Xaa can be Ala, Cys, Asp, Glu, Gly, His, Ile, Lys, Leu, Met, Asn, Gln, Arg, Ser, Thr, Val, or Trp
  misc_feature (10)..(10): Xaa can be Ala, Cys, Asp, Glu, Gly, His, Ile, Lys, Leu, Met, Asn, Pro, Gln, Arg, Ser, Thr, Val, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXCXAYXDQYRATDFV

SEQ ID NO: 26466 - protein, 23 aa, Artificial Sequence
  Description of Artificial Sequence: Synthetic peptide
  Seed: WVKPIIIGCHAYGDQYRATDFVV (IDH1 R132C)
  Core: IIIGCHAYG
  misc_feature (5)..(5): Xaa can be Phe, Ile, Leu, Met, Val, Trp, or Tyr
  misc_feature (8)..(8): Xaa can be Ala, Cys, Asp, Glu, Gly, His, Ile, Lys, Leu, Met, Asn, Gln, Arg, Ser, Thr, Val, or Trp
  misc_feature (10)..(10): Xaa can be Ala, Cys, Asp, Glu, Gly, His, Ile, Lys, Leu, Met, Asn, Pro, Gln, Arg, Ser, Thr, Val, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXCXAYXDQYRATDFVV

SEQ ID NO: 26467 - protein, 24 aa, Artificial Sequence
  Description of Artificial Sequence: Synthetic peptide
  Seed: WVKPIIIGCHAYGDQYRATDFVVP (IDH1 R132C)
  Core: IIIGCHAYG
  misc_feature (5)..(5): Xaa can be Phe, Ile, Leu, Met, Val, Trp, or Tyr
  misc_feature (8)..(8): Xaa can be Ala, Cys, Asp, Glu, Gly, His, Ile, Lys, Leu, Met, Asn, Gln, Arg, Ser, Thr, Val, or Trp
  misc_feature (10)..(10): Xaa can be Ala, Cys, Asp, Glu, Gly, His, Ile, Lys, Leu, Met, Asn, Pro, Gln, Arg, Ser, Thr, Val, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXCXAYXDQYRATDFVVP

SEQ ID NO: 26468 - protein, 25 aa, Artificial Sequence
  Description of Artificial Sequence: Synthetic peptide
  Seed: WVKPIIIGCHAYGDQYRATDFVVPG (IDH1 R132C)
  Core: IIIGCHAYG
  misc_feature (5)..(5): Xaa can be Phe, Ile, Leu, Met, Val, Trp, or Tyr
  misc_feature (8)..(8): Xaa can be Ala, Cys, Asp, Glu, Gly, His, Ile, Lys, Leu, Met, Asn, Gln, Arg, Ser, Thr, Val, or Trp
  misc_feature (10)..(10): Xaa can be Ala, Cys, Asp, Glu, Gly, His, Ile, Lys, Leu, Met, Asn, Pro, Gln, Arg, Ser, Thr, Val, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXCXAYXDQYRATDFVVPG

SEQ ID NO: 26469 - protein, 24 aa, Artificial Sequence
  Description of Artificial Sequence: Synthetic peptide
  Seed: AIICKNIPRLVSGWVKPIIIGHHA (IDH1 R132H)
  Core: VKPIIIGHH
  misc_feature (15)..(15): Xaa can be Phe, Ile, Leu, Met, Val, Trp, or Tyr
  misc_feature (18)..(18): Xaa can be Ala, Cys, Glu, Phe, Gly, His, Ile, Lys, Leu, Met, Asn, Gln, Arg, Ser, Thr, Val, Trp, or Ty r
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AIICKNIPRLVSGWXKPXIXGHXA

SEQ ID NO: 26470 - protein, 25 aa, Artificial Sequence
  Description of Artificial Sequence: Synthetic peptide
  Seed: AIICKNIPRLVSGWVKPIIIGHHAY (IDH1 R132H)
  Core: VKPIIIGHH
  misc_feature (15)..(15): Xaa can be Ala, Cys, Glu, Phe, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AIICKNIPRLVSGWXKPXIXGHXAY

SEQ ID NO: 26471 - protein, 21 aa, Artificial Sequence
  Description of Artificial Sequence: Synthetic peptide
  Seed: CKNIPRLVSGWVKPIIIGHHA (IDH1 R132H)
  Core: VKPIIIGHH
  misc_feature (12)..(12): Xaa can be Ala, Phe, Ile, Leu, Met, Gln, Arg, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Glu, Phe, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, or Tyr
CKNIPRLVSGWXKPXIXGHXA

SEQ ID NO: 26472 - protein, 22 aa, Artificial Sequence
  Description of Artificial Sequence: Synthetic peptide
  Seed: CKNIPRLVSGWVKPIIIGHHAY (IDH1 R132H)
  Core: VKPIIIGHH
  misc_feature (12)..(12): Xaa can be Ala, Cys, Phe, Ile, Lys, Leu, Met, Gln, Arg, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
CKNIPRLVSGWXKPXIXGHXAY

SEQ ID NO: 26473 - protein, 23 aa, Artificial Sequence
  Description of Artificial Sequence: Synthetic peptide
  Seed: CKNIPRLVSGWVKPIIIGHHAYG (IDH1 R132H)
  Core: VKPIIIGHH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
CKNIPRLVSGWXKPXIXGHXAYG

SEQ ID NO: 26474 - protein, 24 aa, Artificial Sequence
  Description of Artificial Sequence: Synthetic peptide
  Seed: CKNIPRLVSGWVKPIIIGHHAYGD (IDH1 R132H)
  Core: VKPIIIGHH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
CKNIPRLVSGWXKPXIXGHXAYGD

SEQ ID NO: 26475 - protein, 24 aa, Artificial Sequence
  Description of Artificial Sequence: Synthetic peptide
  Seed: CKNIPRLVSGWVKPIIIGHHAYGD (IDH1 R132H)
  Core: IIIGHHAYG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
CKNIPRLVSGWVKPXIIXHXAYXD

SEQ ID NO: 26476 - protein, 25 aa, Artificial Sequence
  Description of Artificial Sequence: Synthetic peptide
  Seed: CKNIPRLVSGWVKPIIIGHHAYGDQ (IDH1 R132H)
  Core: VKPIIIGHH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
CKNIPRLVSGWXKPXIXGHXAYGDQ

SEQ ID NO: 26477 - protein, 25 aa, Artificial Sequence
  Description of Artificial Sequence: Synthetic peptide
  Seed: CKNIPRLVSGWVKPIIIGHHAYGDQ (IDH1 R132H)
  Core: IIIGHHAYG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
CKNIPRLVSGWVKPXIIXHXAYXDQ

SEQ ID NO: 26478 - protein, 25 aa, Artificial Sequence
  Description of Artificial Sequence: Synthetic peptide
  Seed: EAIICKNIPRLVSGWVKPIIIGHHA (IDH1 R132H)
  Core: VKPIIIGHH
  misc_feature (16)..(16): Xaa can be Phe, Ile, Leu, Met, Val, Trp, or Tyr
  misc_feature (19)..(19): Xaa can be Ala, Cys, Asp, Glu, Phe, Gly, His, Ile, Lys, Leu, Met, Asn, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
EAIICKNIPRLVSGWXKPXIXGHXA

SEQ ID NO: 26479 - protein, 14 aa, Artificial Sequence
  Description of Artificial Sequence: Synthetic peptide
  Seed: GWVKPIIIGHHAYG (IDH1 R132H)
  Core: VKPIIIGHH
  misc_feature (3)..(3): Xaa can be Phe, Ile, Leu, Met, Val, Trp, or Tyr
  misc_feature (6)..(6): Xaa can be Ala, Cys, Glu, Phe, His, Ile, Lys, Leu, Met, Gln, Arg, Ser, Thr, Val, Trp, or Tyr
  misc_feature (8)..(8): Xaa can be Ala, Gly, His, Ile, Lys, Leu, Met, Asn, Pro, Gln, Arg, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GWXKPXIXGHXAYG

SEQ ID NO: 26480 - protein, 15 aa, Artificial Sequence
  Description of Artificial Sequence: Synthetic peptide
  Seed: GWVKPIIIGHHAYGD (IDH1 R132H)
  Core: VKPIIIGHH
  misc_feature (3)..(3): Xaa can be Ala, Cys, Asp, Glu, Phe, Gly, His, Ile, Lys, Leu, Met, Asn, Pro, Gln, Ser, Thr, Val, Trp, or Tyr
  misc_feature (6)..(6): Xaa can be Ala, Cys, Phe, Gly, His, Ile, Leu, Met, Asn, Ser, Thr, Val, Trp, or Tyr
  misc_feature (8)..(8): Xaa can be Ala, Cys, Asp, Phe, Ile, Leu, Met, Asn, Pro, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GWXKPXIXGHXAYGD

SEQ ID NO: 26481 - protein, 15 aa, Artificial Sequence
  Description of Artificial Sequence: Synthetic peptide
  Seed: GWVKPIIIGHHAYGD (IDH1 R132H)
  Core: IIIGHHAYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXHXAYXD

SEQ ID NO: 26482 - protein, 16 aa, Artificial Sequence
  Description of Artificial Sequence: Synthetic peptide
  Seed: GWVKPIIIGHHAYGDQ (IDH1 R132H)
  Core: IIIGHHAYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXHXAYXDQ

SEQ ID NO: 26483 - protein, 17 aa, Artificial Sequence
  Description of Artificial Sequence: Synthetic peptide
  Seed: GWVKPIIIGHHAYGDQY (IDH1 R132H)
  Core: IIIGHHAYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXHXAYXDQY

SEQ ID NO: 26484 - protein, 19 aa, Artificial Sequence
  Description of Artificial Sequence: Synthetic peptide
  Seed: GWVKPIIIGHHAYGDQYRA (IDH1 R132H)
  Core: IIIGHHAYG
  misc_feature (6)..(6): Xaa can be Ala, Cys, Asp, Glu, Phe, Gly, His, Ile, Leu, Met, Asn, Pro, Gln, Ser, Thr, Val, Trp, or Ty r
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXHXAYXDQYRA

SEQ ID NO: 26485 - protein, 20 aa, Artificial Sequence
  Description of Artificial Sequence: Synthetic peptide
  Seed: GWVKPIIIGHHAYGDQYRAT (IDH1 R132H)
  Core: IIIGHHAYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXHXAYXDQYRAT

SEQ ID NO: 26486 - protein, 21 aa, Artificial Sequence
  Description of Artificial Sequence: Synthetic peptide
  Seed: GWVKPIIIGHHAYGDQYRATD (IDH1 R132H)
  Core: IIIGHHAYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXHXAYXDQYRATD

SEQ ID NO: 26487 - protein, 22 aa, Artificial Sequence
  Description of Artificial Sequence: Synthetic peptide
  Seed: GWVKPIIIGHHAYGDQYRATDF (IDH1 R132H)
  Core: IIIGHHAYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXHXAYXDQYRATDF

SEQ ID NO: 26488 - protein, 23 aa, Artificial Sequence
  Description of Artificial Sequence: Synthetic peptide
  Seed: GWVKPIIIGHHAYGDQYRATDFV (IDH1 R132H)
  Core: IIIGHHAYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXHXAYXDQYRATDFV

SEQ ID NO: 26489 - protein, 24 aa, Artificial Sequence
  Description of Artificial Sequence: Synthetic peptide
  Seed: GWVKPIIIGHHAYGDQYRATDFVV (IDH1 R132H)
  Core: IIIGHHAYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXHXAYXDQYRATDFVV

SEQ ID NO: 26490 - protein, 25 aa, Artificial Sequence
  Description of Artificial Sequence: Synthetic peptide
  Seed: GWVKPIIIGHHAYGDQYRATDFVVP (IDH1 R132H)
  Core: IIIGHHAYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GWVKPXIIXHXAYXDQYRATDFVVP

SEQ ID NO: 26491 - protein, 22 aa, Artificial Sequence
  Description of Artificial Sequence: Synthetic peptide
  Seed: ICKNIPRLVSGWVKPIIIGHHA (IDH1 R132H)
  Core: VKPIIIGHH
  misc_feature (13)..(13): Xaa can be Ala, Phe, Ile, Leu, Met, Gln, Arg, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, or Tyr
ICKNIPRLVSGWXKPXIXGHXA

SEQ ID NO: 26492 - protein, 23 aa, Artificial Sequence
  Description of Artificial Sequence: Synthetic peptide
  Seed: ICKNIPRLVSGWVKPIIIGHHAY (IDH1 R132H)
  Core: VKPIIIGHH
  misc_feature (13)..(13): Xaa can be Ala, Glu, Phe, His, Ile, Lys, Leu, Met, Gln, Arg, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ICKNIPRLVSGWXKPXIXGHXAY

SEQ ID NO: 26493 - protein, 24 aa, Artificial Sequence
  Description of Artificial Sequence: Synthetic peptide
  Seed: ICKNIPRLVSGWVKPIIIGHHAYG (IDH1 R132H)
  Core: VKPIIIGHH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ICKNIPRLVSGWXKPXIXGHXAYG

SEQ ID NO: 26494 - protein, 25 aa, Artificial Sequence
  Description of Artificial Sequence: Synthetic peptide
  Seed: ICKNIPRLVSGWVKPIIIGHHAYGD (IDH1 R132H)
  Core: VKPIIIGHH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ICKNIPRLVSGWXKPXIXGHXAYGD

SEQ ID NO: 26495 - protein, 25 aa, Artificial Sequence
  Description of Artificial Sequence: Synthetic peptide
  Seed: ICKNIPRLVSGWVKPIIIGHHAYGD (IDH1 R132H)
  Core: IIIGHHAYG
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
ICKNIPRLVSGWVKPXIIXHXAYXD

SEQ ID NO: 26496 - protein, 23 aa, Artificial Sequence
  Description of Artificial Sequence: Synthetic peptide
  Seed: IICKNIPRLVSGWVKPIIIGHHA (IDH1 R132H)
  Core: VKPIIIGHH
  misc_feature (14)..(14): Xaa can be Phe, Ile, Leu, Met, Val, Trp, or Tyr
  misc_feature (17)..(17): Xaa can be Ala, Glu, Phe, His, Ile, Lys, Leu, Met, Asn, Gln, Arg, Ser, Thr, Val, Trp, or Tyr
  misc_feature (19)..(19): Xaa can be Ala, Phe, Gly, His, Ile, Lys, Leu, Met, Asn, Pro, Gln, Arg, Ser, Thr, Val, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IICKNIPRLVSGWXKPXIXGHXA

SEQ ID NO: 26497 - protein, 24 aa, Artificial Sequence
  Description of Artificial Sequence: Synthetic peptide
  Seed: IICKNIPRLVSGWVKPIIIGHHAY (IDH1 R132H)
  Core: VKPIIIGHH
  misc_feature (14)..(14): Xaa can be Ala, Cys, Glu, Phe, His, Ile, Lys, Leu, Met, Gln, Arg, Ser, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IICKNIPRLVSGWXKPXIXGHXAY

SEQ ID NO: 26498 - protein, 25 aa, Artificial Sequence
  Description of Artificial Sequence: Synthetic peptide
  Seed: IICKNIPRLVSGWVKPIIIGHHAYG (IDH1 R132H)
  Core: VKPIIIGHH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IICKNIPRLVSGWXKPXIXGHXAYG

SEQ ID NO: 26499 - protein, 19 aa, Artificial Sequence
  Description of Artificial Sequence: Synthetic peptide
  Seed: IPRLVSGWVKPIIIGHHAY (IDH1 R132H)
  Core: VKPIIIGHH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IPRLVSGWXKPXIXGHXAY

SEQ ID NO: 26500 - protein, 20 aa, Artificial Sequence
  Description of Artificial Sequence: Synthetic peptide
  Seed: IPRLVSGWVKPIIIGHHAYG (IDH1 R132H)
  Core: VKPIIIGHH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IPRLVSGWXKPXIXGHXAYG

SEQ ID NO: 26501 - protein, 21 aa, Artificial Sequence
  Description of Artificial Sequence: Synthetic peptide
  Seed: IPRLVSGWVKPIIIGHHAYGD (IDH1 R132H)
  Core: VKPIIIGHH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IPRLVSGWXKPXIXGHXAYGD

SEQ ID NO: 26502 - protein, 21 aa, Artificial Sequence
  Description of Artificial Sequence: Synthetic peptide
  Seed: IPRLVSGWVKPIIIGHHAYGD (IDH1 R132H)
  Core: IIIGHHAYG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IPRLVSGWVKPXIIXHXAYXD

SEQ ID NO: 26503 - protein, 22 aa, Artificial Sequence
  Description of Artificial Sequence: Synthetic peptide
  Seed: IPRLVSGWVKPIIIGHHAYGDQ (IDH1 R132H)
  Core: VKPIIIGHH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IPRLVSGWXKPXIXGHXAYGDQ

SEQ ID NO: 26504 - protein, 22 aa, Artificial Sequence
  Description of Artificial Sequence: Synthetic peptide
  Seed: IPRLVSGWVKPIIIGHHAYGDQ (IDH1 R132H)
  Core: IIIGHHAYG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IPRLVSGWVKPXIIXHXAYXDQ

SEQ ID NO: 26505 - protein, 23 aa, Artificial Sequence
  Description of Artificial Sequence: Synthetic peptide
  Seed: IPRLVSGWVKPIIIGHHAYGDQY (IDH1 R132H)
  Core: IIIGHHAYG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IPRLVSGWVKPXIIXHXAYXDQY

SEQ ID NO: 26506 - protein, 24 aa, Artificial Sequence
  Description of Artificial Sequence: Synthetic peptide
  Seed: IPRLVSGWVKPIIIGHHAYGDQYR (IDH1 R132H)
  Core: IIIGHHAYG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IPRLVSGWVKPXIIXHXAYXDQYR

SEQ ID NO: 26507 - protein, 25 aa, Artificial Sequence
  Description of Artificial Sequence: Synthetic peptide
  Seed: IPRLVSGWVKPIIIGHHAYGDQYRA (IDH1 R132H)
  Core: IIIGHHAYG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IPRLVSGWVKPXIIXHXAYXDQYRA

SEQ ID NO: 26508 - protein, 20 aa, Artificial Sequence
  Description of Artificial Sequence: Synthetic peptide
  Seed: KNIPRLVSGWVKPIIIGHHA (IDH1 R132H)
  Core: VKPIIIGHH
  misc_feature (11)..(11): Xaa can be Ala, Cys, Phe, Ile, Leu, Met, Asn, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KNIPRLVSGWXKPXIXGHXA

SEQ ID NO: 26509 - protein, 21 aa, Artificial Sequence
  Description of Artificial Sequence: Synthetic peptide
  Seed: KNIPRLVSGWVKPIIIGHHAY (IDH1 R132H)
  Core: VKPIIIGHH
  misc_feature (11)..(11): Xaa can be Ala, Cys, Glu, Phe, Ile, Leu, Met, Gln, Arg, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KNIPRLVSGWXKPXIXGHXAY

SEQ ID NO: 26510 - protein, 22 aa, Artificial Sequence
  Description of Artificial Sequence: Synthetic peptide
  Seed: KNIPRLVSGWVKPIIIGHHAYG (IDH1 R132H)
  Core: VKPIIIGHH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KNIPRLVSGWXKPXIXGHXAYG

SEQ ID NO: 26511 - protein, 23 aa, Artificial Sequence
  Description of Artificial Sequence: Synthetic peptide
  Seed: KNIPRLVSGWVKPIIIGHHAYGD (IDH1 R132H)
  Core: VKPIIIGHH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KNIPRLVSGWXKPXIXGHXAYGD

SEQ ID NO: 26512 - protein, 23 aa, Artificial Sequence
  Description of Artificial Sequence: Synthetic peptide
  Seed: KNIPRLVSGWVKPIIIGHHAYGD (IDH1 R132H)
  Core: IIIGHHAYG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KNIPRLVSGWVKPXIIXHXAYXD

SEQ ID NO: 26513 - protein, 24 aa, Artificial Sequence
  Description of Artificial Sequence: Synthetic peptide
  Seed: KNIPRLVSGWVKPIIIGHHAYGDQ (IDH1 R132H)
  Core: VKPIIIGHH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KNIPRLVSGWXKPXIXGHXAYGDQ

SEQ ID NO: 26514 - protein, 24 aa, Artificial Sequence
  Description of Artificial Sequence: Synthetic peptide
  Seed: KNIPRLVSGWVKPIIIGHHAYGDQ (IDH1 R132H)
  Core: IIIGHHAYG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KNIPRLVSGWVKPXIIXHXAYXDQ

SEQ ID NO: 26515 - protein, 25 aa, Artificial Sequence
  Description of Artificial Sequence: Synthetic peptide
  Seed: KNIPRLVSGWVKPIIIGHHAYGDQY (IDH1 R132H)
  Core: VKPIIIGHH
  misc_feature (11)..(11): Xaa can be Ala, Glu, Phe, Ile, Lys, Leu, Met, Gln, Arg, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KNIPRLVSGWXKPXIXGHXAYGDQY

SEQ ID NO: 26516 - protein, 25 aa, Artificial Sequence
  Description of Artificial Sequence: Synthetic peptide
  Seed: KNIPRLVSGWVKPIIIGHHAYGDQY (IDH1 R132H)
  Core: IIIGHHAYG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KNIPRLVSGWVKPXIIXHXAYXDQY

SEQ ID NO: 26517 - protein, 14 aa, Artificial Sequence
  Description of Artificial Sequence: Synthetic peptide
  Seed: KPIIIGHHAYGDQY (IDH1 R132H)
  Core: IIIGHHAYG
  misc_feature (3)..(3): Xaa can be Ala, Cys, Phe, Ile, Leu, Met, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KPXIIXHXAYXDQY

SEQ ID NO: 26518 - protein, 15 aa, Artificial Sequence
  Description of Artificial Sequence: Synthetic peptide
  Seed: KPIIIGHHAYGDQYR (IDH1 R132H)
  Core: IIIGHHAYG
  misc_feature (3)..(3): Xaa can be Ala, Cys, Glu, Phe, His, Ile, Leu, Met, Gln, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KPXIIXHXAYXDQYR

SEQ ID NO: 26519 - protein, 16 aa, Artificial Sequence
  Description of Artificial Sequence: Synthetic peptide
  Seed: KPIIIGHHAYGDQYRA (IDH1 R132H)
  Core: IIIGHHAYG
  misc_feature (3)..(3): Xaa can be Ala, Phe, Ile, Leu, Met, Gln, Thr, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KPXIIXHXAYXDQYRA

SEQ ID NO: 26520 - protein, 17 aa, Artificial Sequence
  Description of Artificial Sequence: Synthetic peptide
  Seed: KPIIIGHHAYGDQYRAT (IDH1 R132H)
  Core: IIIGHHAYG
  misc_feature (3)..(3): Xaa can be Ala, Phe, Ile, Leu, Met, Gln, Thr, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KPXIIXHXAYXDQYRAT

SEQ ID NO: 26521 - protein, 20 aa, Artificial Sequence
  Description of Artificial Sequence: Synthetic peptide
  Seed: KPIIIGHHAYGDQYRATDFV (IDH1 R132H)
  Core: IIIGHHAYG
  misc_feature (3)..(3): Xaa can be Phe, Ile, Leu, Met, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Gly, His, Ile, Lys, Leu, Met, Asn, Pro, Gln, Arg, Ser, Thr, Val, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KPXIIXHXAYXDQYRATDFV

SEQ ID NO: 26522 - protein, 23 aa, Artificial Sequence
  Description of Artificial Sequence: Synthetic peptide
  Seed: KPIIIGHHAYGDQYRATDFVVPG (IDH1 R132H)
  Core: IIIGHHAYG
  misc_feature (3)..(3): Xaa can be Phe, Ile, Leu, Met, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Gly, His, Ile, Lys, Leu, Met, Asn, Pro, Gln, Arg, Ser, Thr, Val, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KPXIIXHXAYXDQYRATDFVVPG

SEQ ID NO: 26523 - protein, 24 aa, Artificial Sequence
  Description of Artificial Sequence: Synthetic peptide
  Seed: KPIIIGHHAYGDQYRATDFVVPGP (IDH1 R132H)
  Core: IIIGHHAYG
  misc_feature (3)..(3): Xaa can be Phe, Ile, Leu, Met, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Gly, His, Ile, Lys, Leu, Met, Asn, Pro, Gln, Arg, Ser, Thr, Val, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KPXIIXHXAYXDQYRATDFVVPGP

SEQ ID NO: 26524 - protein, 25 aa, Artificial Sequence
  Description of Artificial Sequence: Synthetic peptide
  Seed: KPIIIGHHAYGDQYRATDFVVPGPG (IDH1 R132H)
  Core: IIIGHHAYG
  misc_feature (3)..(3): Xaa can be Phe, Ile, Leu, Met, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Gly, His, Ile, Lys, Leu, Met, Asn, Pro, Gln, Arg, Ser, Thr, Val, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KPXIIXHXAYXDQYRATDFVVPGPG

SEQ ID NO: 26525 - protein, 14 aa, Artificial Sequence
  Description of Artificial Sequence: Synthetic peptide
  Seed: LVSGWVKPIIIGHH (IDH1 R132H)
  Core: VKPIIIGHH
  misc_feature (6)..(6): Xaa can be Ala, Cys, Phe, His, Ile, Leu, Met, Asn, Pro, Ser, Thr, Val, Trp, or Tyr
  misc_feature (9)..(9): Xaa can be Ala, Cys, Phe, Gly, His, Ile, Leu, Met, Asn, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWXKPXIXGHX

SEQ ID NO: 26526 - protein, 15 aa, Artificial Sequence
  Description of Artificial Sequence: Synthetic peptide
  Seed: LVSGWVKPIIIGHHA (IDH1 R132H)
  Core: VKPIIIGHH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWXKPXIXGHXA

SEQ ID NO: 26527 - protein, 16 aa, Artificial Sequence
  Description of Artificial Sequence: Synthetic peptide
  Seed: LVSGWVKPIIIGHHAY (IDH1 R132H)
  Core: VKPIIIGHH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWXKPXIXGHXAY

SEQ ID NO: 26528 - protein, 17 aa, Artificial Sequence
  Description of Artificial Sequence: Synthetic peptide
  Seed: LVSGWVKPIIIGHHAYG (IDH1 R132H)
  Core: VKPIIIGHH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWXKPXIXGHXAYG

SEQ ID NO: 26529 - protein, 19 aa, Artificial Sequence
  Description of Artificial Sequence: Synthetic peptide
  Seed: LVSGWVKPIIIGHHAYGDQ (IDH1 R132H)
  Core: VKPIIIGHH
  misc_feature (6)..(6): Xaa can be Ala, Cys, Asp, Glu, Phe, Gly, His, Ile, Lys, Leu, Met, Asn, Pro, Gln, Ser, Thr, Val, Trp, or Tyr
  misc_feature (9)..(9): Xaa can be Ala, Cys, Phe, Gly, His, Ile, Leu, Met, Asn, Ser, Thr, Val, Trp, or Tyr
  misc_feature (11)..(11): Xaa can be Ala, Cys, Asp, Phe, Ile, Leu, Met, Asn, Pro, Ser, Thr, or Val
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWXKPXIXGHXAYGDQ

SEQ ID NO: 26530 - protein, 19 aa, Artificial Sequence
  Description of Artificial Sequence: Synthetic peptide
  Seed: LVSGWVKPIIIGHHAYGDQ (IDH1 R132H)
  Core: IIIGHHAYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWVKPXIIXHXAYXDQ

SEQ ID NO: 26531 - protein, 20 aa, Artificial Sequence
  Description of Artificial Sequence: Synthetic peptide
  Seed: LVSGWVKPIIIGHHAYGDQY (IDH1 R132H)
  Core: IIIGHHAYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWVKPXIIXHXAYXDQY

SEQ ID NO: 26532 - protein, 21 aa, Artificial Sequence
  Description of Artificial Sequence: Synthetic peptide
  Seed: LVSGWVKPIIIGHHAYGDQYR (IDH1 R132H)
  Core: IIIGHHAYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWVKPXIIXHXAYXDQYR

SEQ ID NO: 26533 - protein, 22 aa, Artificial Sequence
  Description of Artificial Sequence: Synthetic peptide
  Seed: LVSGWVKPIIIGHHAYGDQYRA (IDH1 R132H)
  Core: IIIGHHAYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWVKPXIIXHXAYXDQYRA

SEQ ID NO: 26534 - protein, 23 aa, Artificial Sequence
  Description of Artificial Sequence: Synthetic peptide
  Seed: LVSGWVKPIIIGHHAYGDQYRAT (IDH1 R132H)
  Core: IIIGHHAYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWVKPXIIXHXAYXDQYRAT

SEQ ID NO: 26535 - protein, 24 aa, Artificial Sequence
  Description of Artificial Sequence: Synthetic peptide
  Seed: LVSGWVKPIIIGHHAYGDQYRATD (IDH1 R132H)
  Core: IIIGHHAYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWVKPXIIXHXAYXDQYRATD

SEQ ID NO: 26536 - protein, 25 aa, Artificial Sequence
  Description of Artificial Sequence: Synthetic peptide
  Seed: LVSGWVKPIIIGHHAYGDQYRATDF (IDH1 R132H)
  Core: IIIGHHAYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVSGWVKPXIIXHXAYXDQYRATDF

SEQ ID NO: 26537 - protein, 19 aa, Artificial Sequence
  Description of Artificial Sequence: Synthetic peptide
  Seed: NIPRLVSGWVKPIIIGHHA (IDH1 R132H)
  Core: VKPIIIGHH
  misc_feature (10)..(10): Xaa can be Ala, Phe, Ile, Leu, Met, Arg, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Glu, Phe, His, Ile, Lys, Leu, Met, Asn, Pro, Gln, Arg, Ser, Thr, Val, Trp, or Ty r
  misc_feature (18)..(18): Xaa can be Ala, Cys, Asp, Glu, Phe, Gly, His, Ile, Lys, Leu, Met, Asn, Pro, Gln, Arg, Ser, Thr, Val, or Tyr
NIPRLVSGWXKPXIXGHXA

SEQ ID NO: 26538 - protein, 20 aa, Artificial Sequence
  Description of Artificial Sequence: Synthetic peptide
  Seed: NIPRLVSGWVKPIIIGHHAY (IDH1 R132H)
  Core: VKPIIIGHH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NIPRLVSGWXKPXIXGHXAY

SEQ ID NO: 26539 - protein, 21 aa, Artificial Sequence
  Description of Artificial Sequence: Synthetic peptide
  Seed: NIPRLVSGWVKPIIIGHHAYG (IDH1 R132H)
  Core: VKPIIIGHH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NIPRLVSGWXKPXIXGHXAYG

SEQ ID NO: 26540 - protein, 22 aa, Artificial Sequence
  Description of Artificial Sequence: Synthetic peptide
  Seed: NIPRLVSGWVKPIIIGHHAYGD (IDH1 R132H)
  Core: VKPIIIGHH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NIPRLVSGWXKPXIXGHXAYGD

SEQ ID NO: 26541 - protein, 22 aa, Artificial Sequence
  Description of Artificial Sequence: Synthetic peptide
  Seed: NIPRLVSGWVKPIIIGHHAYGD (IDH1 R132H)
  Core: IIIGHHAYG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NIPRLVSGWVKPXIIXHXAYXD

SEQ ID NO: 26542 - protein, 23 aa, Artificial Sequence
  Description of Artificial Sequence: Synthetic peptide
  Seed: NIPRLVSGWVKPIIIGHHAYGDQ (IDH1 R132H)
  Core: VKPIIIGHH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NIPRLVSGWXKPXIXGHXAYGDQ

SEQ ID NO: 26543 - protein, 23 aa, Artificial Sequence
  Description of Artificial Sequence: Synthetic peptide
  Seed: NIPRLVSGWVKPIIIGHHAYGDQ (IDH1 R132H)
  Core: IIIGHHAYG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NIPRLVSGWVKPXIIXHXAYXDQ

SEQ ID NO: 26544 - protein, 24 aa, Artificial Sequence
  Description of Artificial Sequence: Synthetic peptide
  Seed: NIPRLVSGWVKPIIIGHHAYGDQY (IDH1 R132H)
  Core: IIIGHHAYG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NIPRLVSGWVKPXIIXHXAYXDQY

SEQ ID NO: 26545 - protein, 25 aa, Artificial Sequence
  Description of Artificial Sequence: Synthetic peptide
  Seed: NIPRLVSGWVKPIIIGHHAYGDQYR (IDH1 R132H)
  Core: IIIGHHAYG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NIPRLVSGWVKPXIIXHXAYXDQYR

SEQ ID NO: 26546 - protein, 15 aa, Artificial Sequence
  Description of Artificial Sequence: Synthetic peptide
  Seed: PIIIGHHAYGDQYRA (IDH1 R132H)
  Core: IIIGHHAYG
  misc_feature (2)..(2): Xaa can be Phe, Ile, Leu, Met, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Asp, Glu, Gly, His, Ile, Lys, Leu, Asn, Pro, Gln, Arg, Ser, Thr, or Val
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXIIXHXAYXDQYRA

SEQ ID NO: 26547 - protein, 17 aa, Artificial Sequence
  Description of Artificial Sequence: Synthetic peptide
  Seed: PRLVSGWVKPIIIGHHA (IDH1 R132H)
  Core: VKPIIIGHH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWXKPXIXGHXA

SEQ ID NO: 26548 - protein, 18 aa, Artificial Sequence
  Description of Artificial Sequence: Synthetic peptide
  Seed: PRLVSGWVKPIIIGHHAY (IDH1 R132H)
  Core: VKPIIIGHH
  misc_feature (8)..(8): Xaa can be Ala, Cys, Phe, Gly, His, Ile, Leu, Met, Asn, Pro, Gln, Ser, Thr, Val, Trp, or Tyr
  misc_feature (11)..(11): Xaa can be Ala, Cys, Phe, Gly, His, Ile, Leu, Met, Asn, Gln, Ser, Thr, Val, Trp, or Tyr
  misc_feature (13)..(13): Xaa can be Ala, Cys, Asp, Glu, Phe, Gly, Ile, Leu, Met, Asn, Pro, Gln, Ser, Thr, or Val
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWXKPXIXGHXAY

SEQ ID NO: 26549 - protein, 19 aa, Artificial Sequence
  Description of Artificial Sequence: Synthetic peptide
  Seed: PRLVSGWVKPIIIGHHAYG (IDH1 R132H)
  Core: VKPIIIGHH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWXKPXIXGHXAYG

SEQ ID NO: 26550 - protein, 20 aa, Artificial Sequence
  Description of Artificial Sequence: Synthetic peptide
  Seed: PRLVSGWVKPIIIGHHAYGD (IDH1 R132H)
  Core: VKPIIIGHH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWXKPXIXGHXAYGD

SEQ ID NO: 26551 - protein, 20 aa, Artificial Sequence
  Description of Artificial Sequence: Synthetic peptide
  Seed: PRLVSGWVKPIIIGHHAYGD (IDH1 R132H)
  Core: IIIGHHAYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWVKPXIIXHXAYXD

SEQ ID NO: 26552 - protein, 21 aa, Artificial Sequence
  Description of Artificial Sequence: Synthetic peptide
  Seed: PRLVSGWVKPIIIGHHAYGDQ (IDH1 R132H)
  Core: VKPIIIGHH
  misc_feature (8)..(8): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Glu, Phe, Gly, His, Ile, Leu, Met, Asn, Ser, Thr, Val, Trp, or Tyr
  misc_feature (13)..(13): Xaa can be Ala, Cys, Asp, Glu, Phe, Ile, Leu, Met, Asn, Pro, Ser, Thr, or Val
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWXKPXIXGHXAYGDQ

SEQ ID NO: 26553 - protein, 21 aa, Artificial Sequence
  Description of Artificial Sequence: Synthetic peptide
  Seed: PRLVSGWVKPIIIGHHAYGDQ (IDH1 R132H)
  Core: IIIGHHAYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWVKPXIIXHXAYXDQ

SEQ ID NO: 26554 - protein, 22 aa, Artificial Sequence
  Description of Artificial Sequence: Synthetic peptide
  Seed: PRLVSGWVKPIIIGHHAYGDQY (IDH1 R132H)
  Core: IIIGHHAYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWVKPXIIXHXAYXDQY

SEQ ID NO: 26555 - protein, 23 aa, Artificial Sequence
  Description of Artificial Sequence: Synthetic peptide
  Seed: PRLVSGWVKPIIIGHHAYGDQYR (IDH1 R132H)
  Core: IIIGHHAYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWVKPXIIXHXAYXDQYR

SEQ ID NO: 26556 - protein, 24 aa, Artificial Sequence
  Description of Artificial Sequence: Synthetic peptide
  Seed: PRLVSGWVKPIIIGHHAYGDQYRA (IDH1 R132H)
  Core: IIIGHHAYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWVKPXIIXHXAYXDQYRA

SEQ ID NO: 26557 - protein, 25 aa, Artificial Sequence
  Description of Artificial Sequence: Synthetic peptide
  Seed: PRLVSGWVKPIIIGHHAYGDQYRAT (IDH1 R132H)
  Core: IIIGHHAYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PRLVSGWVKPXIIXHXAYXDQYRAT

SEQ ID NO: 26558 - protein, 16 aa, Artificial Sequence
  Description of Artificial Sequence: Synthetic peptide
  Seed: RLVSGWVKPIIIGHHA (IDH1 R132H)
  Core: VKPIIIGHH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWXKPXIXGHXA

SEQ ID NO: 26559 - protein, 17 aa, Artificial Sequence
  Description of Artificial Sequence: Synthetic peptide
  Seed: RLVSGWVKPIIIGHHAY (IDH1 R132H)
  Core: VKPIIIGHH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWXKPXIXGHXAY

SEQ ID NO: 26560 - protein, 18 aa, Artificial Sequence
  Description of Artificial Sequence: Synthetic peptide
  Seed: RLVSGWVKPIIIGHHAYG (IDH1 R132H)
  Core: VKPIIIGHH
  misc_feature (7)..(7): Xaa can be Ala, Cys, Asp, Glu, Phe, Gly, His, Ile, Leu, Met, Asn, Pro, Gln, Ser, Thr, Val, Trp, or Ty r
  misc_feature (10)..(10): Xaa can be Ala, Cys, Asp, Glu, Phe, Gly, His, Ile, Leu, Met, Asn, Gln, Arg, Ser, Thr, Val, Trp, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWXKPXIXGHXAYG

SEQ ID NO: 26561 - protein, 19 aa, Artificial Sequence
  Description of Artificial Sequence: Synthetic peptide
  Seed: RLVSGWVKPIIIGHHAYGD (IDH1 R132H)
  Core: VKPIIIGHH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWXKPXIXGHXAYGD

SEQ ID NO: 26562 - protein, 19 aa, Artificial Sequence
  Description of Artificial Sequence: Synthetic peptide
  Seed: RLVSGWVKPIIIGHHAYGD (IDH1 R132H)
  Core: IIIGHHAYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWVKPXIIXHXAYXD

SEQ ID NO: 26563 - protein, 20 aa, Artificial Sequence
  Description of Artificial Sequence: Synthetic peptide
  Seed: RLVSGWVKPIIIGHHAYGDQ (IDH1 R132H)
  Core: VKPIIIGHH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWXKPXIXGHXAYGDQ

SEQ ID NO: 26564 - protein, 20 aa, Artificial Sequence
  Description of Artificial Sequence: Synthetic peptide
  Seed: RLVSGWVKPIIIGHHAYGDQ (IDH1 R132H)
  Core: IIIGHHAYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWVKPXIIXHXAYXDQ

SEQ ID NO: 26565 - protein, 21 aa, Artificial Sequence
  Description of Artificial Sequence: Synthetic peptide
  Seed: RLVSGWVKPIIIGHHAYGDQY (IDH1 R132H)
  Core: IIIGHHAYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWVKPXIIXHXAYXDQY

SEQ ID NO: 26566 - protein, 22 aa, Artificial Sequence
  Description of Artificial Sequence: Synthetic peptide
  Seed: RLVSGWVKPIIIGHHAYGDQYR (IDH1 R132H)
  Core: IIIGHHAYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWVKPXIIXHXAYXDQYR

SEQ ID NO: 26567 - protein, 23 aa, Artificial Sequence
  Description of Artificial Sequence: Synthetic peptide
  Seed: RLVSGWVKPIIIGHHAYGDQYRA (IDH1 R132H)
  Core: IIIGHHAYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWVKPXIIXHXAYXDQYRA

SEQ ID NO: 26568 - protein, 24 aa, Artificial Sequence
  Description of Artificial Sequence: Synthetic peptide
  Seed: RLVSGWVKPIIIGHHAYGDQYRAT (IDH1 R132H)
  Core: IIIGHHAYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWVKPXIIXHXAYXDQYRAT

SEQ ID NO: 26569 - protein, 25 aa, Artificial Sequence
  Description of Artificial Sequence: Synthetic peptide
  Seed: RLVSGWVKPIIIGHHAYGDQYRATD (IDH1 R132H)
  Core: IIIGHHAYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLVSGWVKPXIIXHXAYXDQYRATD

SEQ ID NO: 26570 - protein, 15 aa, Artificial Sequence
  Description of Artificial Sequence: Synthetic peptide
  Seed: SGWVKPIIIGHHAYG (IDH1 R132H)
  Core: VKPIIIGHH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGWXKPXIXGHXAYG

SEQ ID NO: 26571 - protein, 15 aa, Artificial Sequence
  Description of Artificial Sequence: Synthetic peptide
  Seed: SGWVKPIIIGHHAYG (IDH1 R132H)
  Core: IIIGHHAYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXHXAYX

SEQ ID NO: 26572 - protein, 16 aa, Artificial Sequence
  Description of Artificial Sequence: Synthetic peptide
  Seed: SGWVKPIIIGHHAYGD (IDH1 R132H)
  Core: VKPIIIGHH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Phe, Gly, His, Ile, Leu, Met, Asn, Pro, Gln, Ser, Thr, Val, Trp, or Tyr
  misc_feature (9)..(9): Xaa can be Ala, Cys, Asp, Phe, Ile, Leu, Met, Asn, Pro, Gln, Ser, Thr, or Val
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGWXKPXIXGHXAYGD

SEQ ID NO: 26573 - protein, 16 aa, Artificial Sequence
  Description of Artificial Sequence: Synthetic peptide
  Seed: SGWVKPIIIGHHAYGD (IDH1 R132H)
  Core: IIIGHHAYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXHXAYXD

SEQ ID NO: 26574 - protein, 17 aa, Artificial Sequence
  Description of Artificial Sequence: Synthetic peptide
  Seed: SGWVKPIIIGHHAYGDQ (IDH1 R132H)
  Core: IIIGHHAYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXHXAYXDQ

SEQ ID NO: 26575 - protein, 19 aa, Artificial Sequence
  Description of Artificial Sequence: Synthetic peptide
  Seed: SGWVKPIIIGHHAYGDQYR (IDH1 R132H)
  Core: IIIGHHAYG
  misc_feature (7)..(7): Xaa can be Ala, Cys, Asp, Glu, Phe, Gly, His, Ile, Leu, Met, Asn, Pro, Gln, Ser, Thr, Val, Trp, or Ty r
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXHXAYXDQYR

SEQ ID NO: 26576 - protein, 20 aa, Artificial Sequence
  Description of Artificial Sequence: Synthetic peptide
  Seed: SGWVKPIIIGHHAYGDQYRA (IDH1 R132H)
  Core: IIIGHHAYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXHXAYXDQYRA

SEQ ID NO: 26577 - protein, 21 aa, Artificial Sequence
  Description of Artificial Sequence: Synthetic peptide
  Seed: SGWVKPIIIGHHAYGDQYRAT (IDH1 R132H)
  Core: IIIGHHAYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXHXAYXDQYRAT

SEQ ID NO: 26578 - protein, 22 aa, Artificial Sequence
  Description of Artificial Sequence: Synthetic peptide
  Seed: SGWVKPIIIGHHAYGDQYRATD (IDH1 R132H)
  Core: IIIGHHAYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXHXAYXDQYRATD

SEQ ID NO: 26579 - protein, 23 aa, Artificial Sequence
  Description of Artificial Sequence: Synthetic peptide
  Seed: SGWVKPIIIGHHAYGDQYRATDF (IDH1 R132H)
  Core: IIIGHHAYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXHXAYXDQYRATDF

SEQ ID NO: 26580 - protein, 24 aa, Artificial Sequence
  Description of Artificial Sequence: Synthetic peptide
  Seed: SGWVKPIIIGHHAYGDQYRATDFV (IDH1 R132H)
  Core: IIIGHHAYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXHXAYXDQYRATDFV

SEQ ID NO: 26581 - protein, 25 aa, Artificial Sequence
  Description of Artificial Sequence: Synthetic peptide
  Seed: SGWVKPIIIGHHAYGDQYRATDFVV (IDH1 R132H)
  Core: IIIGHHAYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGWVKPXIIXHXAYXDQYRATDFVV

SEQ ID NO: 26582 - protein, 14 aa, Artificial Sequence
  Description of Artificial Sequence: Synthetic peptide
  Seed: VKPIIIGHHAYGDQ (IDH1 R132H)
  Core: IIIGHHAYG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKPXIIXHXAYXDQ

SEQ ID NO: 26583 - protein, 15 aa, Artificial Sequence
  Description of Artificial Sequence: Synthetic peptide
  Seed: VKPIIIGHHAYGDQY (IDH1 R132H)
  Core: IIIGHHAYG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKPXIIXHXAYXDQY

SEQ ID NO: 26584 - protein, 16 aa, Artificial Sequence
  Description of Artificial Sequence: Synthetic peptide
  Seed: VKPIIIGHHAYGDQYR (IDH1 R132H)
  Core: IIIGHHAYG
  misc_feature (4)..(4): Xaa can be Ala, Cys, Asp, Glu, Phe, Gly, His, Ile, Leu, Met, Asn, Pro, Gln, Ser, Thr, Val, Trp, or Ty r
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKPXIIXHXAYXDQYR

SEQ ID NO: 26585 - protein, 17 aa, Artificial Sequence
  Description of Artificial Sequence: Synthetic peptide
  Seed: VKPIIIGHHAYGDQYRA (IDH1 R132H)
  Core: IIIGHHAYG
  misc_feature (4)..(4): Xaa can be Ala, Cys, Asp, Glu, Phe, Gly, His, Ile, Leu, Met, Asn, Pro, Gln, Ser, Thr, Val, Trp, or Ty r
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKPXIIXHXAYXDQYRA

SEQ ID NO: 26586 - protein, 19 aa, Artificial Sequence
  Description of Artificial Sequence: Synthetic peptide
  Seed: VKPIIIGHHAYGDQYRATD (IDH1 R132H)
  Core: IIIGHHAYG
  misc_feature (4)..(4): Xaa can be Ala, Cys, Phe, His, Ile, Leu, Met, Asn, Pro, Gln, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKPXIIXHXAYXDQYRATD

SEQ ID NO: 26587 - protein, 20 aa, Artificial Sequence
  Description of Artificial Sequence: Synthetic peptide
  Seed: VKPIIIGHHAYGDQYRATDF (IDH1 R132H)
  Core: IIIGHHAYG
  misc_feature (4)..(4): Xaa can be Ala, Cys, Asp, Glu, Phe, Gly, His, Ile, Leu, Met, Asn, Gln, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKPXIIXHXAYXDQYRATDF

SEQ ID NO: 26588 - protein, 21 aa, Artificial Sequence
  Description of Artificial Sequence: Synthetic peptide
  Seed: VKPIIIGHHAYGDQYRATDFV (IDH1 R132H)
  Core: IIIGHHAYG
  misc_feature (4)..(4): Xaa can be Ala, Cys, Phe, His, Ile, Leu, Met, Gln, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKPXIIXHXAYXDQYRATDFV

SEQ ID NO: 26589 - protein, 22 aa, Artificial Sequence
  Description of Artificial Sequence: Synthetic peptide
  Seed: VKPIIIGHHAYGDQYRATDFVV (IDH1 R132H)
  Core: IIIGHHAYG
  misc_feature (4)..(4): Xaa can be Ala, Cys, Phe, His, Ile, Leu, Met, Gln, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKPXIIXHXAYXDQYRATDFVV

SEQ ID NO: 26590 - protein, 23 aa, Artificial Sequence
  Description of Artificial Sequence: Synthetic peptide
  Seed: VKPIIIGHHAYGDQYRATDFVVP (IDH1 R132H)
  Core: IIIGHHAYG
  misc_feature (4)..(4): Xaa can be Ala, Cys, Phe, His, Ile, Leu, Met, Gln, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKPXIIXHXAYXDQYRATDFVVP

SEQ ID NO: 26591 - protein, 24 aa, Artificial Sequence
  Description of Artificial Sequence: Synthetic peptide
  Seed: VKPIIIGHHAYGDQYRATDFVVPG (IDH1 R132H)
  Core: IIIGHHAYG
  misc_feature (4)..(4): Xaa can be Ala, Cys, Phe, His, Ile, Leu, Met, Gln, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKPXIIXHXAYXDQYRATDFVVPG

SEQ ID NO: 26592 - protein, 25 aa, Artificial Sequence
  Description of Artificial Sequence: Synthetic peptide
  Seed: VKPIIIGHHAYGDQYRATDFVVPGP (IDH1 R132H)
  Core: IIIGHHAYG
  misc_feature (4)..(4): Xaa can be Ala, Cys, Phe, His, Ile, Leu, Met, Gln, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKPXIIXHXAYXDQYRATDFVVPGP

SEQ ID NO: 26593 - protein, 15 aa, Artificial Sequence
  Description of Artificial Sequence: Synthetic peptide
  Seed: VSGWVKPIIIGHHAY (IDH1 R132H)
  Core: VKPIIIGHH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSGWXKPXIXGHXAY

SEQ ID NO: 26594 - protein, 16 aa, Artificial Sequence
  Description of Artificial Sequence: Synthetic peptide
  Seed: VSGWVKPIIIGHHAYG (IDH1 R132H)
  Core: VKPIIIGHH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSGWXKPXIXGHXAYG

SEQ ID NO: 26595 - protein, 17 aa, Artificial Sequence
  Description of Artificial Sequence: Synthetic peptide
  Seed: VSGWVKPIIIGHHAYGD (IDH1 R132H)
  Core: VKPIIIGHH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Phe, Gly, His, Ile, Leu, Met, Asn, Pro, Gln, Ser, Thr, Val, Trp, or Tyr
  misc_feature (10)..(10): Xaa can be Ala, Cys, Asp, Glu, Phe, Gly, Ile, Leu, Met, Asn, Pro, Gln, Ser, Thr, or Val
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSGWXKPXIXGHXAYGD

SEQ ID NO: 26596 - protein, 17 aa, Artificial Sequence
  Description of Artificial Sequence: Synthetic peptide
  Seed: VSGWVKPIIIGHHAYGD (IDH1 R132H)
  Core: IIIGHHAYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXHXAYXD

SEQ ID NO: 26597 - protein, 19 aa, Artificial Sequence
  Description of Artificial Sequence: Synthetic peptide
  Seed: VSGWVKPIIIGHHAYGDQY (IDH1 R132H)
  Core: IIIGHHAYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXHXAYXDQY

SEQ ID NO: 26598 - protein, 20 aa, Artificial Sequence
  Description of Artificial Sequence: Synthetic peptide
  Seed: VSGWVKPIIIGHHAYGDQYR (IDH1 R132H)
  Core: IIIGHHAYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXHXAYXDQYR

SEQ ID NO: 26599 - protein, 21 aa, Artificial Sequence
  Description of Artificial Sequence: Synthetic peptide
  Seed: VSGWVKPIIIGHHAYGDQYRA (IDH1 R132H)
  Core: IIIGHHAYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXHXAYXDQYRA

SEQ ID NO: 26600 - protein, 22 aa, Artificial Sequence
  Description of Artificial Sequence: Synthetic peptide
  Seed: VSGWVKPIIIGHHAYGDQYRAT (IDH1 R132H)
  Core: IIIGHHAYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXHXAYXDQYRAT

SEQ ID NO: 26601 - protein, 23 aa, Artificial Sequence
  Description of Artificial Sequence: Synthetic peptide
  Seed: VSGWVKPIIIGHHAYGDQYRATD (IDH1 R132H)
  Core: IIIGHHAYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXHXAYXDQYRATD

SEQ ID NO: 26602 - protein, 24 aa, Artificial Sequence
  Description of Artificial Sequence: Synthetic peptide
  Seed: VSGWVKPIIIGHHAYGDQYRATDF (IDH1 R132H)
  Core: IIIGHHAYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXHXAYXDQYRATDF

SEQ ID NO: 26603 - protein, 25 aa, Artificial Sequence
  Description of Artificial Sequence: Synthetic peptide
  Seed: VSGWVKPIIIGHHAYGDQYRATDFV (IDH1 R132H)
  Core: IIIGHHAYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSGWVKPXIIXHXAYXDQYRATDFV

SEQ ID NO: 26604 - protein, 14 aa, Artificial Sequence
  Description of Artificial Sequence: Synthetic peptide
  Seed: WVKPIIIGHHAYGD (IDH1 R132H)
  Core: IIIGHHAYG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXHXAYXD

SEQ ID NO: 26605 - protein, 15 aa, Artificial Sequence
  Description of Artificial Sequence: Synthetic peptide
  Seed: WVKPIIIGHHAYGDQ (IDH1 R132H)
  Core: IIIGHHAYG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXHXAYXDQ

SEQ ID NO: 26606 - protein, 16 aa, Artificial Sequence
  Description of Artificial Sequence: Synthetic peptide
  Seed: WVKPIIIGHHAYGDQY (IDH1 R132H)
  Core: IIIGHHAYG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXHXAYXDQY

SEQ ID NO: 26607 - protein, 17 aa, Artificial Sequence
  Description of Artificial Sequence: Synthetic peptide
  Seed: WVKPIIIGHHAYGDQYR (IDH1 R132H)
  Core: IIIGHHAYG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXHXAYXDQYR

SEQ ID NO: 26608 - protein, 19 aa, Artificial Sequence
  Description of Artificial Sequence: Synthetic peptide
  Seed: WVKPIIIGHHAYGDQYRAT (IDH1 R132H)
  Core: IIIGHHAYG
  misc_feature (5)..(5): Xaa can be Ala, Cys, Asp, Glu, Phe, Gly, His, Ile, Leu, Met, Asn, Pro, Gln, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXHXAYXDQYRAT

SEQ ID NO: 26609 - protein, 20 aa, Artificial Sequence
  Description of Artificial Sequence: Synthetic peptide
  Seed: WVKPIIIGHHAYGDQYRATD (IDH1 R132H)
  Core: IIIGHHAYG
  misc_feature (5)..(5): Xaa can be Ala, Cys, Asp, Glu, Phe, Gly, His, Ile, Leu, Met, Asn, Pro, Gln, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXHXAYXDQYRATD

SEQ ID NO: 26610 - protein, 21 aa, Artificial Sequence
  Description of Artificial Sequence: Synthetic peptide
  Seed: WVKPIIIGHHAYGDQYRATDF (IDH1 R132H)
  Core: IIIGHHAYG
  misc_feature (5)..(5): Xaa can be Ala, Cys, Asp, Phe, His, Ile, Leu, Met, Asn, Pro, Gln, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXHXAYXDQYRATDF

SEQ ID NO: 26611 - protein, 22 aa, Artificial Sequence
  Description of Artificial Sequence: Synthetic peptide
  Seed: WVKPIIIGHHAYGDQYRATDFV (IDH1 R132H)
  Core: IIIGHHAYG
  misc_feature (5)..(5): Xaa can be Ala, Cys, Asp, Phe, His, Ile, Leu, Met, Asn, Pro, Gln, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXHXAYXDQYRATDFV

SEQ ID NO: 26612 - protein, 23 aa, Artificial Sequence
  Description of Artificial Sequence: Synthetic peptide
  Seed: WVKPIIIGHHAYGDQYRATDFVV (IDH1 R132H)
  Core: IIIGHHAYG
  misc_feature (5)..(5): Xaa can be Ala, Cys, Asp, Glu, Phe, Gly, His, Ile, Leu, Met, Asn, Pro, Gln, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXHXAYXDQYRATDFVV

SEQ ID NO: 26613 - protein, 24 aa, Artificial Sequence
  Description of Artificial Sequence: Synthetic peptide
  Seed: WVKPIIIGHHAYGDQYRATDFVVP (IDH1 R132H)
  Core: IIIGHHAYG
  misc_feature (5)..(5): Xaa can be Ala, Cys, Asp, Glu, Phe, Gly, His, Ile, Leu, Met, Asn, Pro, Gln, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXHXAYXDQYRATDFVVP

SEQ ID NO: 26614 - protein, 25 aa, Artificial Sequence
  Description of Artificial Sequence: Synthetic peptide
  Seed: WVKPIIIGHHAYGDQYRATDFVVPG (IDH1 R132H)
  Core: IIIGHHAYG
  misc_feature (5)..(5): Xaa can be Ala, Cys, Asp, Glu, Phe, Gly, His, Ile, Leu, Met, Asn, Pro, Gln, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVKPXIIXHXAYXDQYRATDFVVPG

SEQ ID NO: 26615 - protein, 13 aa, Artificial Sequence
  Description of Artificial Sequence: Synthetic peptide
  Seed: EYKLVVVGAAGVG (KRAS G12A)
  Core: LVVVGAAGV
  misc_feature (4)..(4): Xaa can be Ala, Cys, Phe, His, Ile, Lys, Leu, Met, Asn, Gln, Arg, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXAGXG

SEQ ID NO: 26616 - protein, 14 aa, Artificial Sequence
  Description of Artificial Sequence: Synthetic peptide
  Seed: EYKLVVVGAAGVGK (KRAS G12A)
  Core: KLVVVGAAG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EYXLVXVXAAXVGK

SEQ ID NO: 26617 - protein, 14 aa, Artificial Sequence
  Description of Artificial Sequence: Synthetic peptide
  Seed: EYKLVVVGAAGVGK (KRAS G12A)
  Core: LVVVGAAGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXAGXGK

SEQ ID NO: 26618 - protein, 15 aa, Artificial Sequence
  Description of Artificial Sequence: Synthetic peptide
  Seed: EYKLVVVGAAGVGKS (KRAS G12A)
  Core: KLVVVGAAG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EYXLVXVXAAXVGKS

SEQ ID NO: 26619 - protein, 15 aa, Artificial Sequence
  Description of Artificial Sequence: Synthetic peptide
  Seed: EYKLVVVGAAGVGKS (KRAS G12A)
  Core: LVVVGAAGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXAGXGKS

SEQ ID NO: 26620 - protein, 16 aa, Artificial Sequence
  Description of Artificial Sequence: Synthetic peptide
  Seed: EYKLVVVGAAGVGKSA (KRAS G12A)
  Core: LVVVGAAGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXAGXGKSA

SEQ ID NO: 26621 - protein, 17 aa, Artificial Sequence
  Description of Artificial Sequence: Synthetic peptide
  Seed: EYKLVVVGAAGVGKSAL (KRAS G12A)
  Core: LVVVGAAGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXAGXGKSAL

SEQ ID NO: 26622 - protein, 18 aa, Artificial Sequence
  Description of Artificial Sequence: Synthetic peptide
  Seed: EYKLVVVGAAGVGKSALT (KRAS G12A)
  Core: LVVVGAAGV
  misc_feature (4)..(4): Xaa can be Ala, Cys, Asp, Glu, Phe, His, Ile, Leu, Met, Asn, Pro, Gln, Arg, Ser, Thr, Val, Trp, or Ty r
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXAGXGKSALT

SEQ ID NO: 26623 - protein, 19 aa, Artificial Sequence
  Description of Artificial Sequence: Synthetic peptide
  Seed: EYKLVVVGAAGVGKSALTI (KRAS G12A)
  Core: LVVVGAAGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXAGXGKSALTI

SEQ ID NO: 26624 - protein, 20 aa, Artificial Sequence
  Description of Artificial Sequence: Synthetic peptide
  Seed: EYKLVVVGAAGVGKSALTIQ (KRAS G12A)
  Core: LVVVGAAGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXAGXGKSALTIQ

SEQ ID NO: 26625 - protein, 21 aa, Artificial Sequence
  Description of Artificial Sequence: Synthetic peptide
  Seed: EYKLVVVGAAGVGKSALTIQL (KRAS G12A)
  Core: LVVVGAAGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXAGXGKSALTIQL

SEQ ID NO: 26626 - protein, 22 aa, Artificial Sequence
  Description of Artificial Sequence: Synthetic peptide
  Seed: EYKLVVVGAAGVGKSALTIQLI (KRAS G12A)
  Core: LVVVGAAGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXAGXGKSALTIQLI

SEQ ID NO: 26627 - protein, 23 aa, Artificial Sequence
  Description of Artificial Sequence: Synthetic peptide
  Seed: EYKLVVVGAAGVGKSALTIQLIQ (KRAS G12A)
  Core: LVVVGAAGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXAGXGKSALTIQLIQ

SEQ ID NO: 26628 - protein, 24 aa, Artificial Sequence
  Description of Artificial Sequence: Synthetic peptide
  Seed: EYKLVVVGAAGVGKSALTIQLIQN (KRAS G12A)
  Core: LVVVGAAGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXAGXGKSALTIQLIQN

SEQ ID NO: 26629 - protein, 25 aa, Artificial Sequence
  Description of Artificial Sequence: Synthetic peptide
  Seed: EYKLVVVGAAGVGKSALTIQLIQNH (KRAS G12A)
  Core: LVVVGAAGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXAGXGKSALTIQLIQNH

SEQ ID NO: 26630 - protein, 13 aa, Artificial Sequence
  Description of Artificial Sequence: Synthetic peptide
  Seed: KLVVVGAAGVGKS (KRAS G12A)
  Core: LVVVGAAGV
  misc_feature (2)..(2): Xaa can be Cys, Phe, Ile, Leu, Met, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXAGXGKS

SEQ ID NO: 26631 - protein, 14 aa, Artificial Sequence
  Description of Artificial Sequence: Synthetic peptide
  Seed: KLVVVGAAGVGKSA (KRAS G12A)
  Core: LVVVGAAGV
  misc_feature (2)..(2): Xaa can be Ala, Cys, Phe, His, Ile, Leu, Met, Asn, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXAGXGKSA

SEQ ID NO: 26632 - protein, 15 aa, Artificial Sequence
  Description of Artificial Sequence: Synthetic peptide
  Seed: KLVVVGAAGVGKSAL (KRAS G12A)
  Core: LVVVGAAGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXAGXGKSAL

SEQ ID NO: 26633 - protein, 15 aa, Artificial Sequence
  Description of Artificial Sequence: Synthetic peptide
  Seed: KLVVVGAAGVGKSAL (KRAS G12A)
  Core: VVGAAGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXAXVGXSAL

SEQ ID NO: 26634 - protein, 16 aa, Artificial Sequence
  Description of Artificial Sequence: Synthetic peptide
  Seed: KLVVVGAAGVGKSALT (KRAS G12A)
  Core: LVVVGAAGV
  misc_feature (2)..(2): Xaa can be Ala, Cys, Phe, His, Ile, Lys, Leu, Met, Asn, Gln, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXAGXGKSALT

SEQ ID NO: 26635 - protein, 16 aa, Artificial Sequence
  Description of Artificial Sequence: Synthetic peptide
  Seed: KLVVVGAAGVGKSALT (KRAS G12A)
  Core: VVGAAGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXAXVGXSALT

SEQ ID NO: 26636 - protein, 17 aa, Artificial Sequence
  Description of Artificial Sequence: Synthetic peptide
  Seed: KLVVVGAAGVGKSALTI (KRAS G12A)
  Core: LVVVGAAGV
  misc_feature (2)..(2): Xaa can be Ala, Cys, Phe, His, Ile, Lys, Leu, Met, Asn, Gln, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXAGXGKSALTI

SEQ ID NO: 26637 - protein, 17 aa, Artificial Sequence
  Description of Artificial Sequence: Synthetic peptide
  Seed: KLVVVGAAGVGKSALTI (KRAS G12A)
  Core: VVGAAGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXAXVGXSALTI

SEQ ID NO: 26638 - protein, 19 aa, Artificial Sequence
  Description of Artificial Sequence: Synthetic peptide
  Seed: KLVVVGAAGVGKSALTIQL (KRAS G12A)
  Core: LVVVGAAGV
  misc_feature (2)..(2): Xaa can be Ala, Cys, Asp, Glu, Phe, His, Ile, Leu, Met, Asn, Pro, Gln, Arg, Ser, Thr, Val, Trp, or Ty r
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXAGXGKSALTIQL

SEQ ID NO: 26639 - protein, 20 aa, Artificial Sequence
  Description of Artificial Sequence: Synthetic peptide
  Seed: KLVVVGAAGVGKSALTIQLI (KRAS G12A)
  Core: LVVVGAAGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXAGXGKSALTIQLI

SEQ ID NO: 26640 - protein, 20 aa, Artificial Sequence
  Description of Artificial Sequence: Synthetic peptide
  Seed: KLVVVGAAGVGKSALTIQLI (KRAS G12A)
  Core: VVGAAGVGK
  misc_feature (4)..(4): Xaa can be Ala, Cys, Asp, Glu, Phe, His, Ile, Lys, Leu, Met, Asn, Pro, Gln, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXAXVGXSALTIQLI

SEQ ID NO: 26641 - protein, 21 aa, Artificial Sequence
  Description of Artificial Sequence: Synthetic peptide
  Seed: KLVVVGAAGVGKSALTIQLIQ (KRAS G12A)
  Core: LVVVGAAGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXAGXGKSALTIQLIQ

SEQ ID NO: 26642 - protein, 22 aa, Artificial Sequence
  Description of Artificial Sequence: Synthetic peptide
  Seed: KLVVVGAAGVGKSALTIQLIQN (KRAS G12A)
  Core: LVVVGAAGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXAGXGKSALTIQLIQN

SEQ ID NO: 26643 - protein, 23 aa, Artificial Sequence
  Description of Artificial Sequence: Synthetic peptide
  Seed: KLVVVGAAGVGKSALTIQLIQNH (KRAS G12A)
  Core: LVVVGAAGV
  misc_feature (2)..(2): Xaa can be Ala, Cys, Asp, Glu, Phe, His, Ile, Leu, Met, Asn, Pro, Gln, Ser, Thr, Val, Trp, or Tyr
  misc_feature (5)..(5): Xaa can be Ala, Cys, Asp, Glu, Phe, His, Ile, Lys, Leu, Met, Asn, Gln, Arg, Ser, Thr, Val, Trp, or Ty r
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXAGXGKSALTIQLIQNH

SEQ ID NO: 26644 - protein, 23 aa, Artificial Sequence
  Description of Artificial Sequence: Synthetic peptide
  Seed: KLVVVGAAGVGKSALTIQLIQNH (KRAS G12A)
  Core: VVGAAGVGK
  misc_feature (4)..(4): Xaa can be Ala, Cys, Glu, Phe, His, Ile, Leu, Met, Pro, Gln, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXAXVGXSALTIQLIQNH

SEQ ID NO: 26645 - protein, 24 aa, Artificial Sequence
  Description of Artificial Sequence: Synthetic peptide
  Seed: KLVVVGAAGVGKSALTIQLIQNHF (KRAS G12A)
  Core: LVVVGAAGV
  misc_feature (2)..(2): Xaa can be Ala, Cys, Asp, Glu, Phe, His, Ile, Leu, Met, Asn, Pro, Gln, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXAGXGKSALTIQLIQNHF

SEQ ID NO: 26646 - protein, 24 aa, Artificial Sequence
  Description of Artificial Sequence: Synthetic peptide
  Seed: KLVVVGAAGVGKSALTIQLIQNHF (KRAS G12A)
  Core: VVGAAGVGK
  misc_feature (4)..(4): Xaa can be Ala, Glu, Phe, His, Ile, Leu, Met, Gln, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXAXVGXSALTIQLIQNHF

SEQ ID NO: 26647 - protein, 25 aa, Artificial Sequence
  Description of Artificial Sequence: Synthetic peptide
  Seed: KLVVVGAAGVGKSALTIQLIQNHFV (KRAS G12A)
  Core: LVVVGAAGV
  misc_feature (2)..(2): Xaa can be Ala, Cys, Phe, His, Ile, Lys, Leu, Met, Asn, Pro, Gln, Arg, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXAGXGKSALTIQLIQNHFV

SEQ ID NO: 26648 - protein, 25 aa, Artificial Sequence
  Description of Artificial Sequence: Synthetic peptide
  Seed: KLVVVGAAGVGKSALTIQLIQNHFV (KRAS G12A)
  Core: VVGAAGVGK
  misc_feature (4)..(4): Xaa can be Glu, Phe, His, Ile, Leu, Met, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Gly, His, Ile, Lys, Asn, Pro, Gln, Arg, Ser, Thr, or Val
  misc_feature (12)..(12): Xaa can be Ala, Cys, Asp, Glu, Phe, Gly, His, Ile, Lys, Leu, Met, Asn, Pro, Gln, Arg, Ser, Thr, Val, or Tyr
KLVXVGXAXVGXSALTIQLIQNHFV

SEQ ID NO: 26649 - protein, 14 aa, Artificial Sequence
  Description of Artificial Sequence: Synthetic peptide
  Seed: LVVVGAAGVGKSAL (KRAS G12A)
  Core: VVGAAGVGK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXAXVGXSAL

SEQ ID NO: 26650 - protein, 15 aa, Artificial Sequence
  Description of Artificial Sequence: Synthetic peptide
  Seed: LVVVGAAGVGKSALT (KRAS G12A)
  Core: VVGAAGVGK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXAXVGXSALT

SEQ ID NO: 26651 - protein, 16 aa, Artificial Sequence
  Description of Artificial Sequence: Synthetic peptide
  Seed: LVVVGAAGVGKSALTI (KRAS G12A)
  Core: VVGAAGVGK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Gly, His, Ile, Lys, Leu, Met, Asn, Pro, Gln, Arg, Ser, Thr, Val, or Tr p
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXAXVGXSALTI

SEQ ID NO: 26652 - protein, 17 aa, Artificial Sequence
  Description of Artificial Sequence: Synthetic peptide
  Seed: LVVVGAAGVGKSALTIQ (KRAS G12A)
  Core: VVGAAGVGK
  misc_feature (3)..(3): Xaa can be Ala, Cys, Asp, Glu, Phe, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Gly, His, Lys, Asn, Pro, Gln, Arg, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXAXVGXSALTIQ

SEQ ID NO: 26653 - protein, 14 aa, Artificial Sequence
  Description of Artificial Sequence: Synthetic peptide
  Seed: MTEYKLVVVGAAGV (KRAS G12A)
  Core: LVVVGAAGV
  misc_feature (6)..(6): Xaa can be Phe, Ile, Leu, Met, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXAGX

SEQ ID NO: 26654 - protein, 15 aa, Artificial Sequence
  Description of Artificial Sequence: Synthetic peptide
  Seed: MTEYKLVVVGAAGVG (KRAS G12A)
  Core: LVVVGAAGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXAGXG

SEQ ID NO: 26655 - protein, 16 aa, Artificial Sequence
  Description of Artificial Sequence: Synthetic peptide
  Seed: MTEYKLVVVGAAGVGK (KRAS G12A)
  Core: KLVVVGAAG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTEYXLVXVXAAXVGK

SEQ ID NO: 26656 - protein, 16 aa, Artificial Sequence
  Description of Artificial Sequence: Synthetic peptide
  Seed: MTEYKLVVVGAAGVGK (KRAS G12A)
  Core: LVVVGAAGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXAGXGK

SEQ ID NO: 26657 - protein, 17 aa, Artificial Sequence
  Description of Artificial Sequence: Synthetic peptide
  Seed: MTEYKLVVVGAAGVGKS (KRAS G12A)
  Core: KLVVVGAAG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTEYXLVXVXAAXVGKS

SEQ ID NO: 26658 - protein, 17 aa, Artificial Sequence
  Description of Artificial Sequence: Synthetic peptide
  Seed: MTEYKLVVVGAAGVGKS (KRAS G12A)
  Core: LVVVGAAGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXAGXGKS

SEQ ID NO: 26659 - protein, 18 aa, Artificial Sequence
  Description of Artificial Sequence: Synthetic peptide
  Seed: MTEYKLVVVGAAGVGKSA (KRAS G12A)
  Core: LVVVGAAGV
  misc_feature (6)..(6): Xaa can be Ala, Cys, Asp, Glu, Phe, Gly, His, Ile, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXAGXGKSA

SEQ ID NO: 26660 - protein, 19 aa, Artificial Sequence
  Description of Artificial Sequence: Synthetic peptide
  Seed: MTEYKLVVVGAAGVGKSAL (KRAS G12A)
  Core: KLVVVGAAG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTEYXLVXVXAAXVGKSAL

SEQ ID NO: 26661 - protein, 19 aa, Artificial Sequence
  Description of Artificial Sequence: Synthetic peptide
  Seed: MTEYKLVVVGAAGVGKSAL (KRAS G12A)
  Core: LVVVGAAGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXAGXGKSAL

SEQ ID NO: 26662 - protein, 20 aa, Artificial Sequence
  Description of Artificial Sequence: Synthetic peptide
  Seed: MTEYKLVVVGAAGVGKSALT (KRAS G12A)
  Core: KLVVVGAAG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTEYXLVXVXAAXVGKSALT

SEQ ID NO: 26663 - protein, 20 aa, Artificial Sequence
  Description of Artificial Sequence: Synthetic peptide
  Seed: MTEYKLVVVGAAGVGKSALT (KRAS G12A)
  Core: LVVVGAAGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXAGXGKSALT

SEQ ID NO: 26664 - protein, 21 aa, Artificial Sequence
  Description of Artificial Sequence: Synthetic peptide
  Seed: MTEYKLVVVGAAGVGKSALTI (KRAS G12A)
  Core: LVVVGAAGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXAGXGKSALTI

SEQ ID NO: 26665 - protein, 22 aa, Artificial Sequence
  Description of Artificial Sequence: Synthetic peptide
  Seed: MTEYKLVVVGAAGVGKSALTIQ (KRAS G12A)
  Core: LVVVGAAGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXAGXGKSALTIQ

SEQ ID NO: 26666 - protein, 23 aa, Artificial Sequence
  Description of Artificial Sequence: Synthetic peptide
  Seed: MTEYKLVVVGAAGVGKSALTIQL (KRAS G12A)
  Core: LVVVGAAGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXAGXGKSALTIQL

SEQ ID NO: 26667 - protein, 24 aa, Artificial Sequence
  Description of Artificial Sequence: Synthetic peptide
  Seed: MTEYKLVVVGAAGVGKSALTIQLI (KRAS G12A)
  Core: LVVVGAAGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXAGXGKSALTIQLI

SEQ ID NO: 26668 - protein, 25 aa, Artificial Sequence
  Description of Artificial Sequence: Synthetic peptide
  Seed: MTEYKLVVVGAAGVGKSALTIQLIQ (KRAS G12A)
  Core: LVVVGAAGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXAGXGKSALTIQLIQ

SEQ ID NO: 26669 - protein, 13 aa, Artificial Sequence
  Description of Artificial Sequence: Synthetic peptide
  Seed: TEYKLVVVGAAGV (KRAS G12A)
  Core: LVVVGAAGV
  misc_feature (5)..(5): Xaa can be Cys, Phe, Ile, Leu, Met, Val, Trp, or Tyr
  misc_feature (8)..(8): Xaa can be Ala, Cys, Asp, Glu, Phe, His, Ile, Lys, Leu, Met, Asn, Gln, Arg, Ser, Thr, Val, Trp, or Ty r
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXAGX

SEQ ID NO: 26670 - protein, 14 aa, Artificial Sequence
  Description of Artificial Sequence: Synthetic peptide
  Seed: TEYKLVVVGAAGVG (KRAS G12A)
  Core: LVVVGAAGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXAGXG

SEQ ID NO: 26671 - protein, 15 aa, Artificial Sequence
  Description of Artificial Sequence: Synthetic peptide
  Seed: TEYKLVVVGAAGVGK (KRAS G12A)
  Core: KLVVVGAAG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEYXLVXVXAAXVGK

SEQ ID NO: 26672 - protein, 15 aa, Artificial Sequence
  Description of Artificial Sequence: Synthetic peptide
  Seed: TEYKLVVVGAAGVGK (KRAS G12A)
  Core: LVVVGAAGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXAGXGK

SEQ ID NO: 26673 - protein, 16 aa, Artificial Sequence
  Description of Artificial Sequence: Synthetic peptide
  Seed: TEYKLVVVGAAGVGKS (KRAS G12A)
  Core: KLVVVGAAG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEYXLVXVXAAXVGKS

SEQ ID NO: 26674 - protein, 16 aa, Artificial Sequence
  Description of Artificial Sequence: Synthetic peptide
  Seed: TEYKLVVVGAAGVGKS (KRAS G12A)
  Core: LVVVGAAGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXAGXGKS

SEQ ID NO: 26675 - protein, 17 aa, Artificial Sequence
  Description of Artificial Sequence: Synthetic peptide
  Seed: TEYKLVVVGAAGVGKSA (KRAS G12A)
  Core: KLVVVGAAG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEYXLVXVXAAXVGKSA

SEQ ID NO: 26676 - protein, 17 aa, Artificial Sequence
  Description of Artificial Sequence: Synthetic peptide
  Seed: TEYKLVVVGAAGVGKSA (KRAS G12A)
  Core: LVVVGAAGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXAGXGKSA

SEQ ID NO: 26677 - protein, 18 aa, Artificial Sequence
  Description of Artificial Sequence: Synthetic peptide
  Seed: TEYKLVVVGAAGVGKSAL (KRAS G12A)
  Core: LVVVGAAGV
  misc_feature (5)..(5): Xaa can be Ala, Cys, Asp, Glu, Phe, His, Ile, Leu, Met, Asn, Pro, Gln, Arg, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXAGXGKSAL

SEQ ID NO: 26678 - protein, 19 aa, Artificial Sequence
  Description of Artificial Sequence: Synthetic peptide
  Seed: TEYKLVVVGAAGVGKSALT (KRAS G12A)
  Core: KLVVVGAAG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEYXLVXVXAAXVGKSALT

SEQ ID NO: 26679 - protein, 19 aa, Artificial Sequence
  Description of Artificial Sequence: Synthetic peptide
  Seed: TEYKLVVVGAAGVGKSALT (KRAS G12A)
  Core: LVVVGAAGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXAGXGKSALT

SEQ ID NO: 26680 - protein, 20 aa, Artificial Sequence
  Description of Artificial Sequence: Synthetic peptide
  Seed: TEYKLVVVGAAGVGKSALTI (KRAS G12A)
  Core: KLVVVGAAG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEYXLVXVXAAXVGKSALTI

SEQ ID NO: 26681 - protein, 20 aa, Artificial Sequence
  Description of Artificial Sequence: Synthetic peptide
  Seed: TEYKLVVVGAAGVGKSALTI (KRAS G12A)
  Core: LVVVGAAGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXAGXGKSALTI

SEQ ID NO: 26682 - protein, 21 aa, Artificial Sequence
  Description of Artificial Sequence: Synthetic peptide
  Seed: TEYKLVVVGAAGVGKSALTIQ (KRAS G12A)
  Core: LVVVGAAGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXAGXGKSALTIQ

SEQ ID NO: 26683 - protein, 22 aa, Artificial Sequence
  Description of Artificial Sequence: Synthetic peptide
  Seed: TEYKLVVVGAAGVGKSALTIQL (KRAS G12A)
  Core: LVVVGAAGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXAGXGKSALTIQL

SEQ ID NO: 26684 - protein, 23 aa, Artificial Sequence
  Description of Artificial Sequence: Synthetic peptide
  Seed: TEYKLVVVGAAGVGKSALTIQLI (KRAS G12A)
  Core: LVVVGAAGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXAGXGKSALTIQLI

SEQ ID NO: 26685 - protein, 24 aa, Artificial Sequence
  Description of Artificial Sequence: Synthetic peptide
  Seed: TEYKLVVVGAAGVGKSALTIQLIQ (KRAS G12A)
  Core: LVVVGAAGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXAGXGKSALTIQLIQ

SEQ ID NO: 26686 - protein, 25 aa, Artificial Sequence
  Description of Artificial Sequence: Synthetic peptide
  Seed: TEYKLVVVGAAGVGKSALTIQLIQN (KRAS G12A)
  Core: LVVVGAAGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXAGXGKSALTIQLIQN

SEQ ID NO: 26687 - protein, 15 aa, Artificial Sequence
  Description of Artificial Sequence: Synthetic peptide
  Seed: VVVGAAGVGKSALTI (KRAS G12A)
  Core: VVGAAGVGK
  misc_feature (2)..(2): Xaa can be Ala, Cys, Asp, Glu, Phe, His, Ile, Lys, Leu, Met, Asn, Pro, Gln, Arg, Thr, Val, Trp, or Ty r
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Gly, His, Ile, Lys, Met, Asn, Pro, Gln, Arg, Ser, Thr, or Val
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXVGXAXVGXSALTI

SEQ ID NO: 26688 - protein, 13 aa, Artificial Sequence
  Description of Artificial Sequence: Synthetic peptide
  Seed: YKLVVVGAAGVGK (KRAS G12A)
  Core: LVVVGAAGV
  misc_feature (3)..(3): Xaa can be Ala, Cys, Phe, His, Ile, Leu, Met, Asn, Gln, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXAGXGK

SEQ ID NO: 26689 - protein, 14 aa, Artificial Sequence
  Description of Artificial Sequence: Synthetic peptide
  Seed: YKLVVVGAAGVGKS (KRAS G12A)
  Core: LVVVGAAGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXAGXGKS

SEQ ID NO: 26690 - protein, 15 aa, Artificial Sequence
  Description of Artificial Sequence: Synthetic peptide
  Seed: YKLVVVGAAGVGKSA (KRAS G12A)
  Core: LVVVGAAGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXAGXGKSA

SEQ ID NO: 26691 - protein, 16 aa, Artificial Sequence
  Description of Artificial Sequence: Synthetic peptide
  Seed: YKLVVVGAAGVGKSAL (KRAS G12A)
  Core: LVVVGAAGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXAGXGKSAL

SEQ ID NO: 26692 - protein, 17 aa, Artificial Sequence
  Description of Artificial Sequence: Synthetic peptide
  Seed: YKLVVVGAAGVGKSALT (KRAS G12A)
  Core: LVVVGAAGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXAGXGKSALT

SEQ ID NO: 26693 - protein, 18 aa, Artificial Sequence
  Description of Artificial Sequence: Synthetic peptide
  Seed: YKLVVVGAAGVGKSALTI (KRAS G12A)
  Core: LVVVGAAGV
  misc_feature (3)..(3): Xaa can be Ala, Cys, Phe, His, Ile, Leu, Met, Asn, Gln, Thr, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXAGXGKSALTI

SEQ ID NO: 26694 - protein, 19 aa, Artificial Sequence
  Description of Artificial Sequence: Synthetic peptide
  Seed: YKLVVVGAAGVGKSALTIQ (KRAS G12A)
  Core: LVVVGAAGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXAGXGKSALTIQ

SEQ ID NO: 26695 - protein, 20 aa, Artificial Sequence
  Description of Artificial Sequence: Synthetic peptide
  Seed: YKLVVVGAAGVGKSALTIQL (KRAS G12A)
  Core: LVVVGAAGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXAGXGKSALTIQL

SEQ ID NO: 26696 - protein, 20 aa, Artificial Sequence
  Description of Artificial Sequence: Synthetic peptide
  Seed: YKLVVVGAAGVGKSALTIQL (KRAS G12A)
  Core: VVGAAGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXAXVGXSALTIQL

SEQ ID NO: 26697 - protein, 21 aa, Artificial Sequence
  Description of Artificial Sequence: Synthetic peptide
  Seed: YKLVVVGAAGVGKSALTIQLI (KRAS G12A)
  Core: LVVVGAAGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXAGXGKSALTIQLI

SEQ ID NO: 26698 - protein, 22 aa, Artificial Sequence
  Description of Artificial Sequence: Synthetic peptide
  Seed: YKLVVVGAAGVGKSALTIQLIQ (KRAS G12A)
  Core: LVVVGAAGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXAGXGKSALTIQLIQ

SEQ ID NO: 26699 - protein, 23 aa, Artificial Sequence
  Description of Artificial Sequence: Synthetic peptide
  Seed: YKLVVVGAAGVGKSALTIQLIQN (KRAS G12A)
  Core: LVVVGAAGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXAGXGKSALTIQLIQN

SEQ ID NO: 26700 - protein, 24 aa, Artificial Sequence
  Description of Artificial Sequence: Synthetic peptide
  Seed: YKLVVVGAAGVGKSALTIQLIQNH (KRAS G12A)
  Core: LVVVGAAGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXAGXGKSALTIQLIQNH

SEQ ID NO: 26701 - protein, 25 aa, Artificial Sequence
  Description of Artificial Sequence: Synthetic peptide
  Seed: YKLVVVGAAGVGKSALTIQLIQNHF (KRAS G12A)
  Core: LVVVGAAGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXAGXGKSALTIQLIQNHF

SEQ ID NO: 26702 - protein, 13 aa, Artificial Sequence
  Description of Artificial Sequence: Synthetic peptide
  Seed: EYKLVVVGACGVG (KRAS G12C)
  Core: LVVVGACGV
  misc_feature (4)..(4): Xaa can be Cys, Phe, Ile, Leu, Met, Val, Trp, or Tyr
  misc_feature (7)..(7): Xaa can be Ala, Cys, Asp, Glu, Phe, Gly, His, Ile, Lys, Leu, Met, Asn, Gln, Ser, Thr, Val, or Trp
  misc_feature (9)..(9): Xaa can be Ala, Asp, Glu, Gly, His, Ile, Asn, Pro, Gln, Ser, Thr, or Val
  misc_feature (12)..(12): Xaa can be Ala, Cys, Asp, Glu, Phe, Gly, His, Ile, Lys, Leu, Met, Asn, Pro, Gln, Arg, Ser, Thr, Val, or Tyr
EYKXVVXGXCGXG

SEQ ID NO: 26703 - protein, 14 aa, Artificial Sequence
  Description of Artificial Sequence: Synthetic peptide
  Seed: EYKLVVVGACGVGK (KRAS G12C)
  Core: LVVVGACGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXCGXGK

SEQ ID NO: 26704 - protein, 15 aa, Artificial Sequence
  Description of Artificial Sequence: Synthetic peptide
  Seed: EYKLVVVGACGVGKS (KRAS G12C)
  Core: LVVVGACGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXCGXGKS

SEQ ID NO: 26705 - protein, 16 aa, Artificial Sequence
  Description of Artificial Sequence: Synthetic peptide
  Seed: EYKLVVVGACGVGKSA (KRAS G12C)
  Core: LVVVGACGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXCGXGKSA

SEQ ID NO: 26706 - protein, 17 aa, Artificial Sequence
  Description of Artificial Sequence: Synthetic peptide
  Seed: EYKLVVVGACGVGKSAL (KRAS G12C)
  Core: LVVVGACGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXCGXGKSAL

SEQ ID NO: 26707 - protein, 19 aa, Artificial Sequence
  Description of Artificial Sequence: Synthetic peptide
  Seed: EYKLVVVGACGVGKSALTI (KRAS G12C)
  Core: LVVVGACGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXCGXGKSALTI

SEQ ID NO: 26708 - protein, 20 aa, Artificial Sequence
  Description of Artificial Sequence: Synthetic peptide
  Seed: EYKLVVVGACGVGKSALTIQ (KRAS G12C)
  Core: LVVVGACGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXCGXGKSALTIQ

SEQ ID NO: 26709 - protein, 21 aa, Artificial Sequence
  Description of Artificial Sequence: Synthetic peptide
  Seed: EYKLVVVGACGVGKSALTIQL (KRAS G12C)
  Core: LVVVGACGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXCGXGKSALTIQL

SEQ ID NO: 26710 - protein, 22 aa, Artificial Sequence
  Description of Artificial Sequence: Synthetic peptide
  Seed: EYKLVVVGACGVGKSALTIQLI (KRAS G12C)
  Core: LVVVGACGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXCGXGKSALTIQLI

SEQ ID NO: 26711 - protein, 23 aa, Artificial Sequence
  Description of Artificial Sequence: Synthetic peptide
  Seed: EYKLVVVGACGVGKSALTIQLIQ (KRAS G12C)
  Core: LVVVGACGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXCGXGKSALTIQLIQ

SEQ ID NO: 26712 - protein, 24 aa, Artificial Sequence
  Description of Artificial Sequence: Synthetic peptide
  Seed: EYKLVVVGACGVGKSALTIQLIQN (KRAS G12C)
  Core: LVVVGACGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXCGXGKSALTIQLIQN

SEQ ID NO: 26713 - protein, 25 aa, Artificial Sequence
  Description of Artificial Sequence: Synthetic peptide
  Seed: EYKLVVVGACGVGKSALTIQLIQNH (KRAS G12C)
  Core: LVVVGACGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXCGXGKSALTIQLIQNH

SEQ ID NO: 26714 - protein, 14 aa, Artificial Sequence
  Description of Artificial Sequence: Synthetic peptide
  Seed: KLVVVGACGVGKSA (KRAS G12C)
  Core: LVVVGACGV
  misc_feature (2)..(2): Xaa can be Ala, Cys, Phe, His, Ile, Leu, Met, Gln, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXCGXGKSA

SEQ ID NO: 26715 - protein, 15 aa, Artificial Sequence
  Description of Artificial Sequence: Synthetic peptide
  Seed: KLVVVGACGVGKSAL (KRAS G12C)
  Core: LVVVGACGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXCGXGKSAL

SEQ ID NO: 26716 - protein, 15 aa, Artificial Sequence
  Description of Artificial Sequence: Synthetic peptide
  Seed: KLVVVGACGVGKSAL (KRAS G12C)
  Core: VVGACGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXCXVGXSAL

SEQ ID NO: 26717 - protein, 16 aa, Artificial Sequence
  Description of Artificial Sequence: Synthetic peptide
  Seed: KLVVVGACGVGKSALT (KRAS G12C)
  Core: LVVVGACGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXCGXGKSALT

SEQ ID NO: 26718 - protein, 17 aa, Artificial Sequence
  Description of Artificial Sequence: Synthetic peptide
  Seed: KLVVVGACGVGKSALTI (KRAS G12C)
  Core: LVVVGACGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXCGXGKSALTI

SEQ ID NO: 26719 - protein, 17 aa, Artificial Sequence
  Description of Artificial Sequence: Synthetic peptide
  Seed: KLVVVGACGVGKSALTI (KRAS G12C)
  Core: VVGACGVGK
  misc_feature (4)..(4): Xaa can be Ala, Glu, Phe, His, Ile, Leu, Met, Asn, Gln, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXCXVGXSALTI

SEQ ID NO: 26720 - protein, 19 aa, Artificial Sequence
  Description of Artificial Sequence: Synthetic peptide
  Seed: KLVVVGACGVGKSALTIQL (KRAS G12C)
  Core: LVVVGACGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXCGXGKSALTIQL

SEQ ID NO: 26721 - protein, 20 aa, Artificial Sequence
  Description of Artificial Sequence: Synthetic peptide
  Seed: KLVVVGACGVGKSALTIQLI (KRAS G12C)
  Core: LVVVGACGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXCGXGKSALTIQLI

SEQ ID NO: 26722 - protein, 15 aa, Artificial Sequence
  Description of Artificial Sequence: Synthetic peptide
  Seed: MTEYKLVVVGACGVG (KRAS G12C)
  Core: LVVVGACGV
  misc_feature (6)..(6): Xaa can be Cys, Phe, His, Ile, Lys, Leu, Met, Asn, Gln, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXCGXG

SEQ ID NO: 26723 - protein, 16 aa, Artificial Sequence
  Description of Artificial Sequence: Synthetic peptide
  Seed: MTEYKLVVVGACGVGK (KRAS G12C)
  Core: LVVVGACGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXCGXGK

SEQ ID NO: 26724 - protein, 17 aa, Artificial Sequence
  Description of Artificial Sequence: Synthetic peptide
  Seed: MTEYKLVVVGACGVGKS (KRAS G12C)
  Core: LVVVGACGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXCGXGKS

SEQ ID NO: 26725 - protein, 18 aa, Artificial Sequence
  Description of Artificial Sequence: Synthetic peptide
  Seed: MTEYKLVVVGACGVGKSA (KRAS G12C)
  Core: LVVVGACGV
  misc_feature (6)..(6): Xaa can be Ala, Cys, Asp, Phe, His, Ile, Leu, Met, Asn, Gln, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Asp, Glu, Phe, Gly, His, Ile, Leu, Met, Asn, Pro, Gln, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXCGXGKSA

SEQ ID NO: 26726 - protein, 19 aa, Artificial Sequence
  Description of Artificial Sequence: Synthetic peptide
  Seed: MTEYKLVVVGACGVGKSAL (KRAS G12C)
  Core: LVVVGACGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXCGXGKSAL

SEQ ID NO: 26727 - protein, 20 aa, Artificial Sequence
  Description of Artificial Sequence: Synthetic peptide
  Seed: MTEYKLVVVGACGVGKSALT (KRAS G12C)
  Core: LVVVGACGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXCGXGKSALT

SEQ ID NO: 26728 - protein, 21 aa, Artificial Sequence
  Description of Artificial Sequence: Synthetic peptide
  Seed: MTEYKLVVVGACGVGKSALTI (KRAS G12C)
  Core: LVVVGACGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXCGXGKSALTI

SEQ ID NO: 26729 - protein, 22 aa, Artificial Sequence
  Description of Artificial Sequence: Synthetic peptide
  Seed: MTEYKLVVVGACGVGKSALTIQ (KRAS G12C)
  Core: LVVVGACGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXCGXGKSALTIQ

SEQ ID NO: 26730 - protein, 23 aa, Artificial Sequence
  Description of Artificial Sequence: Synthetic peptide
  Seed: MTEYKLVVVGACGVGKSALTIQL (KRAS G12C)
  Core: LVVVGACGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXCGXGKSALTIQL

SEQ ID NO: 26731 - protein, 24 aa, Artificial Sequence
  Description of Artificial Sequence: Synthetic peptide
  Seed: MTEYKLVVVGACGVGKSALTIQLI (KRAS G12C)
  Core: LVVVGACGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXCGXGKSALTIQLI

SEQ ID NO: 26732 - protein, 25 aa, Artificial Sequence
  Description of Artificial Sequence: Synthetic peptide
  Seed: MTEYKLVVVGACGVGKSALTIQLIQ (KRAS G12C)
  Core: LVVVGACGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXCGXGKSALTIQLIQ

SEQ ID NO: 26733 - protein, 15 aa, Artificial Sequence
  Description of Artificial Sequence: Synthetic peptide
  Seed: TEYKLVVVGACGVGK (KRAS G12C)
  Core: LVVVGACGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXCGXGK

SEQ ID NO: 26734 - protein, 16 aa, Artificial Sequence
  Description of Artificial Sequence: Synthetic peptide
  Seed: TEYKLVVVGACGVGKS (KRAS G12C)
  Core: LVVVGACGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXCGXGKS

SEQ ID NO: 26735 - protein, 17 aa, Artificial Sequence
  Description of Artificial Sequence: Synthetic peptide
  Seed: TEYKLVVVGACGVGKSA (KRAS G12C)
  Core: LVVVGACGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXCGXGKSA

SEQ ID NO: 26736 - protein, 18 aa, Artificial Sequence
  Description of Artificial Sequence: Synthetic peptide
  Seed: TEYKLVVVGACGVGKSAL (KRAS G12C)
  Core: LVVVGACGV
  misc_feature (5)..(5): Xaa can be Cys, Phe, His, Ile, Leu, Met, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Asp, Glu, Gly, His, Ile, Leu, Met, Asn, Pro, Gln, Ser, Thr, or Val
  misc_feature (13)..(13): Xaa can be Ala, Cys, Asp, Glu, Phe, Gly, His, Ile, Lys, Leu, Met, Asn, Pro, Gln, Arg, Ser, Thr, Val, or Tyr
TEYKXVVXGXCGXGKSAL

SEQ ID NO: 26737 - protein, 19 aa, Artificial Sequence
  Description of Artificial Sequence: Synthetic peptide
  Seed: TEYKLVVVGACGVGKSALT (KRAS G12C)
  Core: LVVVGACGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXCGXGKSALT

SEQ ID NO: 26738 - protein, 20 aa, Artificial Sequence
  Description of Artificial Sequence: Synthetic peptide
  Seed: TEYKLVVVGACGVGKSALTI (KRAS G12C)
  Core: LVVVGACGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXCGXGKSALTI

SEQ ID NO: 26739 - protein, 21 aa, Artificial Sequence
  Description of Artificial Sequence: Synthetic peptide
  Seed: TEYKLVVVGACGVGKSALTIQ (KRAS G12C)
  Core: LVVVGACGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXCGXGKSALTIQ

SEQ ID NO: 26740 - protein, 22 aa, Artificial Sequence
  Description of Artificial Sequence: Synthetic peptide
  Seed: TEYKLVVVGACGVGKSALTIQL (KRAS G12C)
  Core: LVVVGACGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXCGXGKSALTIQL

SEQ ID NO: 26741 - protein, 23 aa, Artificial Sequence
  Description of Artificial Sequence: Synthetic peptide
  Seed: TEYKLVVVGACGVGKSALTIQLI (KRAS G12C)
  Core: LVVVGACGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXCGXGKSALTIQLI

SEQ ID NO: 26742 - protein, 24 aa, Artificial Sequence
  Description of Artificial Sequence: Synthetic peptide
  Seed: TEYKLVVVGACGVGKSALTIQLIQ (KRAS G12C)
  Core: LVVVGACGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXCGXGKSALTIQLIQ

SEQ ID NO: 26743 - protein, 25 aa, Artificial Sequence
  Description of Artificial Sequence: Synthetic peptide
  Seed: TEYKLVVVGACGVGKSALTIQLIQN (KRAS G12C)
  Core: LVVVGACGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXCGXGKSALTIQLIQN

SEQ ID NO: 26744 - protein, 13 aa, Artificial Sequence
  Description of Artificial Sequence: Synthetic peptide
  Seed: YKLVVVGACGVGK (KRAS G12C)
  Core: LVVVGACGV
  misc_feature (3)..(3): Xaa can be Cys, Phe, His, Ile, Leu, Met, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, or Tr p
  misc_feature (8)..(8): Xaa can be Ala, Asp, Glu, Gly, His, Ile, Lys, Leu, Met, Asn, Pro, Gln, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXCGXGK

SEQ ID NO: 26745 - protein, 14 aa, Artificial Sequence
  Description of Artificial Sequence: Synthetic peptide
  Seed: YKLVVVGACGVGKS (KRAS G12C)
  Core: LVVVGACGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXCGXGKS

SEQ ID NO: 26746 - protein, 15 aa, Artificial Sequence
  Description of Artificial Sequence: Synthetic peptide
  Seed: YKLVVVGACGVGKSA (KRAS G12C)
  Core: LVVVGACGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXCGXGKSA

SEQ ID NO: 26747 - protein, 15 aa, Artificial Sequence
  Description of Artificial Sequence: Synthetic peptide
  Seed: YKLVVVGACGVGKSA (KRAS G12C)
  Core: VVGACGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXCXVGXSA

SEQ ID NO: 26748 - protein, 16 aa, Artificial Sequence
  Description of Artificial Sequence: Synthetic peptide
  Seed: YKLVVVGACGVGKSAL (KRAS G12C)
  Core: LVVVGACGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXCGXGKSAL

SEQ ID NO: 26749 - protein, 16 aa, Artificial Sequence
  Description of Artificial Sequence: Synthetic peptide
  Seed: YKLVVVGACGVGKSAL (KRAS G12C)
  Core: VVGACGVGK
  misc_feature (5)..(5): Xaa can be Ala, Cys, Phe, His, Ile, Leu, Met, Asn, Pro, Gln, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXCXVGXSAL

SEQ ID NO: 26750 - protein, 17 aa, Artificial Sequence
  Description of Artificial Sequence: Synthetic peptide
  Seed: YKLVVVGACGVGKSALT (KRAS G12C)
  Core: LVVVGACGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXCGXGKSALT

SEQ ID NO: 26751 - protein, 17 aa, Artificial Sequence
  Description of Artificial Sequence: Synthetic peptide
  Seed: YKLVVVGACGVGKSALT (KRAS G12C)
  Core: VVGACGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXCXVGXSALT

SEQ ID NO: 26752 - protein, 19 aa, Artificial Sequence
  Description of Artificial Sequence: Synthetic peptide
  Seed: YKLVVVGACGVGKSALTIQ (KRAS G12C)
  Core: LVVVGACGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXCGXGKSALTIQ

SEQ ID NO: 26753 - protein, 20 aa, Artificial Sequence
  Description of Artificial Sequence: Synthetic peptide
  Seed: YKLVVVGACGVGKSALTIQL (KRAS G12C)
  Core: LVVVGACGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXCGXGKSALTIQL

SEQ ID NO: 26754 - protein, 21 aa, Artificial Sequence
  Description of Artificial Sequence: Synthetic peptide
  Seed: YKLVVVGACGVGKSALTIQLI (KRAS G12C)
  Core: LVVVGACGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXCGXGKSALTIQLI

SEQ ID NO: 26755 - protein, 22 aa, Artificial Sequence
  Description of Artificial Sequence: Synthetic peptide
  Seed: YKLVVVGACGVGKSALTIQLIQ (KRAS G12C)
  Core: LVVVGACGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXCGXGKSALTIQLIQ

SEQ ID NO: 26756 - protein, 23 aa, Artificial Sequence
  Description of Artificial Sequence: Synthetic peptide
  Seed: YKLVVVGACGVGKSALTIQLIQN (KRAS G12C)
  Core: LVVVGACGV
  misc_feature (3)..(3): Xaa can be Ala, Cys, Asp, Glu, Phe, Gly, His, Ile, Lys, Leu, Met, Pro, Gln, Arg, Thr, Val, Trp, or Ty r
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXCGXGKSALTIQLIQN

SEQ ID NO: 26757 - protein, 13 aa, Artificial Sequence
  Description of Artificial Sequence: Synthetic peptide
  Seed: EYKLVVVGADGVG (KRAS G12D)
  Core: LVVVGADGV
  misc_feature (4)..(4): Xaa can be Phe, Ile, Leu, Met, Trp, or Tyr
  misc_feature (7)..(7): Xaa can be Ala, Cys, Glu, Phe, Ile, Leu, Met, Asn, Gln, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Ser, Thr, Val, Trp, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXDGXG

SEQ ID NO: 26758 - protein, 14 aa, Artificial Sequence
  Description of Artificial Sequence: Synthetic peptide
  Seed: EYKLVVVGADGVGK (KRAS G12D)
  Core: LVVVGADGV
  misc_feature (4)..(4): Xaa can be Ala, Cys, Asp, Glu, Phe, Gly, His, Ile, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXDGXGK

SEQ ID NO: 26759 - protein, 15 aa, Artificial Sequence
  Description of Artificial Sequence: Synthetic peptide
  Seed: EYKLVVVGADGVGKS (KRAS G12D)
  Core: LVVVGADGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXDGXGKS

SEQ ID NO: 26760 - protein, 16 aa, Artificial Sequence
  Description of Artificial Sequence: Synthetic peptide
  Seed: EYKLVVVGADGVGKSA (KRAS G12D)
  Core: LVVVGADGV
  misc_feature (4)..(4): Xaa can be Ala, Cys, Glu, Phe, His, Ile, Lys, Leu, Met, Asn, Pro, Gln, Arg, Ser, Thr, Val, Trp, or Ty r
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXDGXGKSA

SEQ ID NO: 26761 - protein, 16 aa, Artificial Sequence
  Description of Artificial Sequence: Synthetic peptide
  Seed: EYKLVVVGADGVGKSA (KRAS G12D)
  Core: VVGADGVGK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EYKLVXVGXDXVGXSA

SEQ ID NO: 26762 - protein, 17 aa, Artificial Sequence
  Description of Artificial Sequence: Synthetic peptide
  Seed: EYKLVVVGADGVGKSAL (KRAS G12D)
  Core: LVVVGADGV
  misc_feature (4)..(4): Xaa can be Ala, Cys, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXDGXGKSAL

SEQ ID NO: 26763 - protein, 17 aa, Artificial Sequence
  Description of Artificial Sequence: Synthetic peptide
  Seed: EYKLVVVGADGVGKSAL (KRAS G12D)
  Core: VVGADGVGK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EYKLVXVGXDXVGXSAL

SEQ ID NO: 26764 - protein, 18 aa, Artificial Sequence
  Description of Artificial Sequence: Synthetic peptide
  Seed: EYKLVVVGADGVGKSALT (KRAS G12D)
  Core: LVVVGADGV
  misc_feature (4)..(4): Xaa can be Ala, Cys, Glu, Phe, His, Ile, Leu, Met, Asn, Gln, Ser, Thr, Val, Trp, or Tyr
  misc_feature (7)..(7): Xaa can be Ala, Cys, Glu, Phe, His, Ile, Leu, Met, Asn, Gln, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Ser, Thr, Val, Trp, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXDGXGKSALT

SEQ ID NO: 26765 - protein, 19 aa, Artificial Sequence
  Description of Artificial Sequence: Synthetic peptide
  Seed: EYKLVVVGADGVGKSALTI (KRAS G12D)
  Core: LVVVGADGV
  misc_feature (4)..(4): Xaa can be Ala, Cys, Asp, Glu, Phe, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXDGXGKSALTI

SEQ ID NO: 26766 - protein, 20 aa, Artificial Sequence
  Description of Artificial Sequence: Synthetic peptide
  Seed: EYKLVVVGADGVGKSALTIQ (KRAS G12D)
  Core: LVVVGADGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXDGXGKSALTIQ

SEQ ID NO: 26767 - protein, 20 aa, Artificial Sequence
  Description of Artificial Sequence: Synthetic peptide
  Seed: EYKLVVVGADGVGKSALTIQ (KRAS G12D)
  Core: VVGADGVGK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EYKLVXVGXDXVGXSALTIQ

SEQ ID NO: 26768 - protein, 21 aa, Artificial Sequence
  Description of Artificial Sequence: Synthetic peptide
  Seed: EYKLVVVGADGVGKSALTIQL (KRAS G12D)
  Core: LVVVGADGV
  misc_feature (4)..(4): Xaa can be Ala, Cys, Asp, Glu, Phe, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXDGXGKSALTIQL

SEQ ID NO: 26769 - protein, 22 aa, Artificial Sequence
  Description of Artificial Sequence: Synthetic peptide
  Seed: EYKLVVVGADGVGKSALTIQLI (KRAS G12D)
  Core: LVVVGADGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXDGXGKSALTIQLI

SEQ ID NO: 26770 - protein, 23 aa, Artificial Sequence
  Description of Artificial Sequence: Synthetic peptide
  Seed: EYKLVVVGADGVGKSALTIQLIQ (KRAS G12D)
  Core: LVVVGADGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXDGXGKSALTIQLIQ

SEQ ID NO: 26771 - protein, 24 aa, Artificial Sequence
  Description of Artificial Sequence: Synthetic peptide
  Seed: EYKLVVVGADGVGKSALTIQLIQN (KRAS G12D)
  Core: LVVVGADGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXDGXGKSALTIQLIQN

SEQ ID NO: 26772 - protein, 25 aa, Artificial Sequence
  Description of Artificial Sequence: Synthetic peptide
  Seed: EYKLVVVGADGVGKSALTIQLIQNH (KRAS G12D)
  Core: LVVVGADGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXDGXGKSALTIQLIQNH

SEQ ID NO: 26773 - protein, 14 aa, Artificial Sequence
  Description of Artificial Sequence: Synthetic peptide
  Seed: KLVVVGADGVGKSA (KRAS G12D)
  Core: LVVVGADGV
  misc_feature (2)..(2): Xaa can be Cys, Phe, Ile, Leu, Met, Val, Trp, or Tyr
  misc_feature (5)..(5): Xaa can be Ala, Cys, Glu, Phe, Gly, His, Ile, Lys, Leu, Met, Asn, Gln, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXDGXGKSA

SEQ ID NO: 26774 - protein, 15 aa, Artificial Sequence
  Description of Artificial Sequence: Synthetic peptide
  Seed: KLVVVGADGVGKSAL (KRAS G12D)
  Core: LVVVGADGV
  misc_feature (2)..(2): Xaa can be Cys, Phe, His, Ile, Leu, Met, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXDGXGKSAL

SEQ ID NO: 26775 - protein, 15 aa, Artificial Sequence
  Description of Artificial Sequence: Synthetic peptide
  Seed: KLVVVGADGVGKSAL (KRAS G12D)
  Core: VVGADGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXDXVGXSAL

SEQ ID NO: 26776 - protein, 16 aa, Artificial Sequence
  Description of Artificial Sequence: Synthetic peptide
  Seed: KLVVVGADGVGKSALT (KRAS G12D)
  Core: LVVVGADGV
  misc_feature (2)..(2): Xaa can be Cys, Phe, Ile, Leu, Met, Val, Trp, or Tyr
  misc_feature (5)..(5): Xaa can be Ala, Cys, Glu, Phe, Gly, His, Ile, Lys, Leu, Met, Asn, Gln, Arg, Ser, Thr, Val, Trp, or Ty r
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXDGXGKSALT

SEQ ID NO: 26777 - protein, 17 aa, Artificial Sequence
  Description of Artificial Sequence: Synthetic peptide
  Seed: KLVVVGADGVGKSALTI (KRAS G12D)
  Core: LVVVGADGV
  misc_feature (2)..(2): Xaa can be Cys, Phe, Ile, Leu, Met, Thr, Val, Trp, or Tyr
  misc_feature (5)..(5): Xaa can be Ala, Cys, Glu, Phe, Gly, His, Ile, Lys, Leu, Met, Asn, Gln, Arg, Ser, Thr, Val, Trp, or Ty r
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXDGXGKSALTI

SEQ ID NO: 26778 - protein, 17 aa, Artificial Sequence
  Description of Artificial Sequence: Synthetic peptide
  Seed: KLVVVGADGVGKSALTI (KRAS G12D)
  Core: VVGADGVGK
  misc_feature (4)..(4): Xaa can be Ala, Cys, Phe, His, Ile, Leu, Met, Gln, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXDXVGXSALTI

SEQ ID NO: 26779 - protein, 19 aa, Artificial Sequence
  Description of Artificial Sequence: Synthetic peptide
  Seed: KLVVVGADGVGKSALTIQL (KRAS G12D)
  Core: LVVVGADGV
  misc_feature (2)..(2): Xaa can be Ala, Cys, Phe, His, Ile, Leu, Met, Gln, Ser, Thr, Val, Trp, or Tyr
  misc_feature (5)..(5): Xaa can be Ala, Cys, Asp, Glu, Phe, His, Ile, Lys, Leu, Met, Asn, Gln, Arg, Ser, Thr, Val, Trp, or Ty r
  misc_feature (7)..(7): Xaa can be Ala, Cys, Asp, Glu, Phe, Gly, Ile, Leu, Met, Asn, Pro, Gln, Ser, Thr, Val, Trp, or Tyr
  misc_feature (10)..(10): Xaa can be Ala, Cys, Asp, Glu, Phe, Gly, His, Ile, Leu, Met, Asn, Pro, Gln, Ser, Thr, Val, Trp, or Ty r
KXVVXGXDGXGKSALTIQL

SEQ ID NO: 26780 - protein, 20 aa, Artificial Sequence
  Description of Artificial Sequence: Synthetic peptide
  Seed: KLVVVGADGVGKSALTIQLI (KRAS G12D)
  Core: LVVVGADGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXDGXGKSALTIQLI

SEQ ID NO: 26781 - protein, 21 aa, Artificial Sequence
  Description of Artificial Sequence: Synthetic peptide
  Seed: KLVVVGADGVGKSALTIQLIQ (KRAS G12D)
  Core: LVVVGADGV
  misc_feature (2)..(2): Xaa can be Ala, Cys, Asp, Glu, Phe, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXDGXGKSALTIQLIQ

SEQ ID NO: 26782 - protein, 22 aa, Artificial Sequence
  Description of Artificial Sequence: Synthetic peptide
  Seed: KLVVVGADGVGKSALTIQLIQN (KRAS G12D)
  Core: LVVVGADGV
  misc_feature (2)..(2): Xaa can be Ala, Cys, Asp, Glu, Phe, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXDGXGKSALTIQLIQN

SEQ ID NO: 26783 - protein, 23 aa, Artificial Sequence
  Description of Artificial Sequence: Synthetic peptide
  Seed: KLVVVGADGVGKSALTIQLIQNH (KRAS G12D)
  Core: VVGADGVGK
  misc_feature (4)..(4): Xaa can be Cys, Phe, His, Ile, Leu, Met, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXDXVGXSALTIQLIQNH

SEQ ID NO: 26784 - protein, 24 aa, Artificial Sequence
  Description of Artificial Sequence: Synthetic peptide
  Seed: KLVVVGADGVGKSALTIQLIQNHF (KRAS G12D)
  Core: VVGADGVGK
  misc_feature (4)..(4): Xaa can be Ala, Phe, His, Ile, Leu, Met, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXDXVGXSALTIQLIQNHF

SEQ ID NO: 26785 - protein, 25 aa, Artificial Sequence
  Description of Artificial Sequence: Synthetic peptide
  Seed: KLVVVGADGVGKSALTIQLIQNHFV (KRAS G12D)
  Core: LVVVGADGV
  misc_feature (2)..(2): Xaa can be Cys, Phe, Ile, Leu, Met, Val, Trp, or Tyr
  misc_feature (5)..(5): Xaa can be Ala, Cys, Asp, Glu, Phe, His, Ile, Lys, Leu, Met, Asn, Gln, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, or Tyr
  misc_feature (10)..(10): Xaa can be Ala, Phe, Gly, His, Ile, Lys, Leu, Met, Asn, Gln, Arg, Ser, Thr, Val, Trp, or Tyr
KXVVXGXDGXGKSALTIQLIQNHFV

SEQ ID NO: 26786 - protein, 15 aa, Artificial Sequence
  Description of Artificial Sequence: Synthetic peptide
  Seed: LVVVGADGVGKSALT (KRAS G12D)
  Core: VVGADGVGK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXDXVGXSALT

SEQ ID NO: 26787 - protein, 15 aa, Artificial Sequence
  Description of Artificial Sequence: Synthetic peptide
  Seed: MTEYKLVVVGADGVG (KRAS G12D)
  Core: LVVVGADGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXDGXG

SEQ ID NO: 26788 - protein, 16 aa, Artificial Sequence
  Description of Artificial Sequence: Synthetic peptide
  Seed: MTEYKLVVVGADGVGK (KRAS G12D)
  Core: LVVVGADGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXDGXGK

SEQ ID NO: 26789 - protein, 17 aa, Artificial Sequence
  Description of Artificial Sequence: Synthetic peptide
  Seed: MTEYKLVVVGADGVGKS (KRAS G12D)
  Core: LVVVGADGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXDGXGKS

SEQ ID NO: 26790 - protein, 18 aa, Artificial Sequence
  Description of Artificial Sequence: Synthetic peptide
  Seed: MTEYKLVVVGADGVGKSA (KRAS G12D)
  Core: LVVVGADGV
  misc_feature (6)..(6): Xaa can be Ala, Cys, Glu, Phe, His, Ile, Leu, Met, Asn, Gln, Ser, Thr, Val, Trp, or Tyr
  misc_feature (9)..(9): Xaa can be Ala, Cys, Asp, Glu, Phe, Gly, His, Ile, Leu, Met, Asn, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXDGXGKSA

SEQ ID NO: 26791 - protein, 19 aa, Artificial Sequence
  Description of Artificial Sequence: Synthetic peptide
  Seed: MTEYKLVVVGADGVGKSAL (KRAS G12D)
  Core: LVVVGADGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXDGXGKSAL

SEQ ID NO: 26792 - protein, 20 aa, Artificial Sequence
  Description of Artificial Sequence: Synthetic peptide
  Seed: MTEYKLVVVGADGVGKSALT (KRAS G12D)
  Core: LVVVGADGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXDGXGKSALT

SEQ ID NO: 26793 - protein, 20 aa, Artificial Sequence
  Description of Artificial Sequence: Synthetic peptide
  Seed: MTEYKLVVVGADGVGKSALT (KRAS G12D)
  Core: VVGADGVGK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKLVXVGXDXVGXSALT

SEQ ID NO: 26794 - protein, 21 aa, Artificial Sequence
  Description of Artificial Sequence: Synthetic peptide
  Seed: MTEYKLVVVGADGVGKSALTI (KRAS G12D)
  Core: LVVVGADGV
  misc_feature (6)..(6): Xaa can be Ala, Cys, Asp, Glu, Phe, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXDGXGKSALTI

SEQ ID NO: 26795 - protein, 22 aa, Artificial Sequence
  Description of Artificial Sequence: Synthetic peptide
  Seed: MTEYKLVVVGADGVGKSALTIQ (KRAS G12D)
  Core: LVVVGADGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXDGXGKSALTIQ

SEQ ID NO: 26796 - protein, 23 aa, Artificial Sequence
  Description of Artificial Sequence: Synthetic peptide
  Seed: MTEYKLVVVGADGVGKSALTIQL (KRAS G12D)
  Core: LVVVGADGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXDGXGKSALTIQL

SEQ ID NO: 26797 - protein, 24 aa, Artificial Sequence
  Description of Artificial Sequence: Synthetic peptide
  Seed: MTEYKLVVVGADGVGKSALTIQLI (KRAS G12D)
  Core: LVVVGADGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXDGXGKSALTIQLI

SEQ ID NO: 26798 - protein, 25 aa, Artificial Sequence
  Description of Artificial Sequence: Synthetic peptide
  Seed: MTEYKLVVVGADGVGKSALTIQLIQ (KRAS G12D)
  Core: LVVVGADGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXDGXGKSALTIQLIQ

SEQ ID NO: 26799 - protein, 25 aa, Artificial Sequence
  Description of Artificial Sequence: Synthetic peptide
  Seed: MTEYKLVVVGADGVGKSALTIQLIQ (KRAS G12D)
  Core: VVGADGVGK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Ser, Thr, Val, Trp, or Tyr
  misc_feature (13)..(13): Xaa can be Ala, Cys, Asp, Glu, Phe, Gly, Ile, Lys, Leu, Met, Asn, Pro, Gln, Ser, Thr, Val, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKLVXVGXDXVGXSALTIQLIQ

SEQ ID NO: 26800 - protein, 14 aa, Artificial Sequence
  Description of Artificial Sequence: Synthetic peptide
  Seed: TEYKLVVVGADGVG (KRAS G12D)
  Core: LVVVGADGV
  misc_feature (5)..(5): Xaa can be Ala, Cys, Asp, Glu, Phe, His, Ile, Lys, Leu, Met, Asn, Pro, Gln, Arg, Ser, Thr, Val, Trp, or Tyr
  misc_feature (8)..(8): Xaa can be Ala, Cys, Glu, Phe, Gly, His, Ile, Lys, Leu, Met, Asn, Gln, Arg, Ser, Thr, Val, Trp, or Ty r
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXDGXG

SEQ ID NO: 26801 - protein, 15 aa, Artificial Sequence
  Description of Artificial Sequence: Synthetic peptide
  Seed: TEYKLVVVGADGVGK (KRAS G12D)
  Core: LVVVGADGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXDGXGK

SEQ ID NO: 26802 - protein, 16 aa, Artificial Sequence
  Description of Artificial Sequence: Synthetic peptide
  Seed: TEYKLVVVGADGVGKS (KRAS G12D)
  Core: LVVVGADGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXDGXGKS

SEQ ID NO: 26803 - protein, 17 aa, Artificial Sequence
  Description of Artificial Sequence: Synthetic peptide
  Seed: TEYKLVVVGADGVGKSA (KRAS G12D)
  Core: LVVVGADGV
  misc_feature (5)..(5): Xaa can be Ala, Cys, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXDGXGKSA

SEQ ID NO: 26804 - protein, 17 aa, Artificial Sequence
  Description of Artificial Sequence: Synthetic peptide
  Seed: TEYKLVVVGADGVGKSA (KRAS G12D)
  Core: VVGADGVGK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Phe, Gly, His, Ile, Lys, Leu, Met, Asn, Pro, Gln, Arg, Ser, Thr, Val, Trp, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TEYKLVXVGXDXVGXSA

SEQ ID NO: 26805 - protein, 18 aa, Artificial Sequence
  Description of Artificial Sequence: Synthetic peptide
  Seed: TEYKLVVVGADGVGKSAL (KRAS G12D)
  Core: LVVVGADGV
  misc_feature (5)..(5): Xaa can be Ala, Cys, Glu, Phe, His, Ile, Leu, Met, Asn, Gln, Ser, Thr, Val, Trp, or Tyr
  misc_feature (8)..(8): Xaa can be Ala, Cys, Asp, Glu, Phe, Gly, His, Ile, Leu, Met, Asn, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXDGXGKSAL

SEQ ID NO: 26806 - protein, 19 aa, Artificial Sequence
  Description of Artificial Sequence: Synthetic peptide
  Seed: TEYKLVVVGADGVGKSALT (KRAS G12D)
  Core: LVVVGADGV
  misc_feature (5)..(5): Xaa can be Ala, Cys, Asp, Glu, Phe, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXDGXGKSALT

SEQ ID NO: 26807 - protein, 20 aa, Artificial Sequence
  Description of Artificial Sequence: Synthetic peptide
  Seed: TEYKLVVVGADGVGKSALTI (KRAS G12D)
  Core: LVVVGADGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXDGXGKSALTI

SEQ ID NO: 26808 - protein, 20 aa, Artificial Sequence
  Description of Artificial Sequence: Synthetic peptide
  Seed: TEYKLVVVGADGVGKSALTI (KRAS G12D)
  Core: VVGADGVGK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TEYKLVXVGXDXVGXSALTI

SEQ ID NO: 26809 - protein, 21 aa, Artificial Sequence
  Description of Artificial Sequence: Synthetic peptide
  Seed: TEYKLVVVGADGVGKSALTIQ (KRAS G12D)
  Core: LVVVGADGV
  misc_feature (5)..(5): Xaa can be Ala, Cys, Asp, Glu, Phe, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXDGXGKSALTIQ

SEQ ID NO: 26810 - protein, 22 aa, Artificial Sequence
  Description of Artificial Sequence: Synthetic peptide
  Seed: TEYKLVVVGADGVGKSALTIQL (KRAS G12D)
  Core: LVVVGADGV
  misc_feature (5)..(5): Xaa can be Ala, Cys, Asp, Glu, Phe, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXDGXGKSALTIQL

SEQ ID NO: 26811 - protein, 23 aa, Artificial Sequence
  Description of Artificial Sequence: Synthetic peptide
  Seed: TEYKLVVVGADGVGKSALTIQLI (KRAS G12D)
  Core: LVVVGADGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXDGXGKSALTIQLI

SEQ ID NO: 26812 - protein, 24 aa, Artificial Sequence
  Description of Artificial Sequence: Synthetic peptide
  Seed: TEYKLVVVGADGVGKSALTIQLIQ (KRAS G12D)
  Core: LVVVGADGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXDGXGKSALTIQLIQ

SEQ ID NO: 26813 - protein, 25 aa, Artificial Sequence
  Description of Artificial Sequence: Synthetic peptide
  Seed: TEYKLVVVGADGVGKSALTIQLIQN (KRAS G12D)
  Core: LVVVGADGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXDGXGKSALTIQLIQN

SEQ ID NO: 26814 - protein, 25 aa, Artificial Sequence
  Description of Artificial Sequence: Synthetic peptide
  Seed: TEYKLVVVGADGVGKSALTIQLIQN (KRAS G12D)
  Core: VVGADGVGK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Phe, Gly, His, Ile, Leu, Met, Asn, Pro, Ser, Thr, Val, or Trp
  misc_feature (12)..(12): Xaa can be Ala, Cys, Asp, Glu, Phe, Gly, Ile, Lys, Leu, Met, Asn, Pro, Gln, Ser, Thr, or Val
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TEYKLVXVGXDXVGXSALTIQLIQN

SEQ ID NO: 26815 - protein, 14 aa, Artificial Sequence
  Description of Artificial Sequence: Synthetic peptide
  Seed: YKLVVVGADGVGKS (KRAS G12D)
  Core: LVVVGADGV
  misc_feature (3)..(3): Xaa can be Ala, Cys, Phe, His, Ile, Leu, Met, Asn, Gln, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXDGXGKS

SEQ ID NO: 26816 - protein, 15 aa, Artificial Sequence
  Description of Artificial Sequence: Synthetic peptide
  Seed: YKLVVVGADGVGKSA (KRAS G12D)
  Core: LVVVGADGV
  misc_feature (3)..(3): Xaa can be Ala, Cys, Asp, Glu, Phe, Gly, His, Ile, Lys, Leu, Met, Asn, Pro, Gln, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXDGXGKSA

SEQ ID NO: 26817 - protein, 16 aa, Artificial Sequence
  Description of Artificial Sequence: Synthetic peptide
  Seed: YKLVVVGADGVGKSAL (KRAS G12D)
  Core: LVVVGADGV
  misc_feature (3)..(3): Xaa can be Ala, Cys, Phe, His, Ile, Leu, Met, Asn, Gln, Ser, Thr, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXDGXGKSAL

SEQ ID NO: 26818 - protein, 16 aa, Artificial Sequence
  Description of Artificial Sequence: Synthetic peptide
  Seed: YKLVVVGADGVGKSAL (KRAS G12D)
  Core: VVGADGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXDXVGXSAL

SEQ ID NO: 26819 - protein, 17 aa, Artificial Sequence
  Description of Artificial Sequence: Synthetic peptide
  Seed: YKLVVVGADGVGKSALT (KRAS G12D)
  Core: LVVVGADGV
  misc_feature (3)..(3): Xaa can be Ala, Cys, Phe, His, Ile, Leu, Met, Asn, Gln, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXDGXGKSALT

SEQ ID NO: 26820 - protein, 17 aa, Artificial Sequence
  Description of Artificial Sequence: Synthetic peptide
  Seed: YKLVVVGADGVGKSALT (KRAS G12D)
  Core: VVGADGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXDXVGXSALT

SEQ ID NO: 26821 - protein, 18 aa, Artificial Sequence
  Description of Artificial Sequence: Synthetic peptide
  Seed: YKLVVVGADGVGKSALTI (KRAS G12D)
  Core: LVVVGADGV
  misc_feature (3)..(3): Xaa can be Cys, Phe, Ile, Leu, Met, Asn, Val, Trp, or Tyr
  misc_feature (6)..(6): Xaa can be Ala, Phe, His, Ile, Leu, Met, Asn, Gln, Ser, Thr, Val, Trp, or Tyr
  misc_feature (8)..(8): Xaa can be Ala, Cys, Asp, Phe, Gly, Ile, Leu, Met, Asn, Pro, Ser, Thr, or Val
  misc_feature (11)..(11): Xaa can be Ala, Cys, Asp, Glu, Phe, Gly, His, Ile, Leu, Met, Asn, Gln, Ser, Thr, Val, Trp, or Tyr
YKXVVXGXDGXGKSALTI

SEQ ID NO: 26822 - protein, 19 aa, Artificial Sequence
  Description of Artificial Sequence: Synthetic peptide
  Seed: YKLVVVGADGVGKSALTIQ (KRAS G12D)
  Core: LVVVGADGV
  misc_feature (3)..(3): Xaa can be Ala, Cys, Glu, Phe, His, Ile, Leu, Met, Asn, Gln, Ser, Thr, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXDGXGKSALTIQ

SEQ ID NO: 26823 - protein, 20 aa, Artificial Sequence
  Description of Artificial Sequence: Synthetic peptide
  Seed: YKLVVVGADGVGKSALTIQL (KRAS G12D)
  Core: LVVVGADGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXDGXGKSALTIQL

SEQ ID NO: 26824 - protein, 20 aa, Artificial Sequence
  Description of Artificial Sequence: Synthetic peptide
  Seed: YKLVVVGADGVGKSALTIQL (KRAS G12D)
  Core: VVGADGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXDXVGXSALTIQL

SEQ ID NO: 26825 - protein, 21 aa, Artificial Sequence
  Description of Artificial Sequence: Synthetic peptide
  Seed: YKLVVVGADGVGKSALTIQLI (KRAS G12D)
  Core: LVVVGADGV
  misc_feature (3)..(3): Xaa can be Ala, Cys, Asp, Glu, Phe, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXDGXGKSALTIQLI

SEQ ID NO: 26826 - protein, 22 aa, Artificial Sequence
  Description of Artificial Sequence: Synthetic peptide
  Seed: YKLVVVGADGVGKSALTIQLIQ (KRAS G12D)
  Core: LVVVGADGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXDGXGKSALTIQLIQ

SEQ ID NO: 26827 - protein, 22 aa, Artificial Sequence
  Description of Artificial Sequence: Synthetic peptide
  Seed: YKLVVVGADGVGKSALTIQLIQ (KRAS G12D)
  Core: VVGADGVGK
  misc_feature (5)..(5): Xaa can be Ala, Cys, Phe, His, Ile, Leu, Met, Gln, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXDXVGXSALTIQLIQ

SEQ ID NO: 26828 - protein, 23 aa, Artificial Sequence
  Description of Artificial Sequence: Synthetic peptide
  Seed: YKLVVVGADGVGKSALTIQLIQN (KRAS G12D)
  Core: LVVVGADGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXDGXGKSALTIQLIQN

SEQ ID NO: 26829 - protein, 23 aa, Artificial Sequence
  Description of Artificial Sequence: Synthetic peptide
  Seed: YKLVVVGADGVGKSALTIQLIQN (KRAS G12D)
  Core: VVGADGVGK
  misc_feature (5)..(5): Xaa can be Ala, Cys, Phe, His, Ile, Leu, Met, Gln, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXDXVGXSALTIQLIQN

SEQ ID NO: 26830 - protein, 24 aa, Artificial Sequence
  Description of Artificial Sequence: Synthetic peptide
  Seed: YKLVVVGADGVGKSALTIQLIQNH (KRAS G12D)
  Core: LVVVGADGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXDGXGKSALTIQLIQNH

SEQ ID NO: 26831 - protein, 24 aa, Artificial Sequence
  Description of Artificial Sequence: Synthetic peptide
  Seed: YKLVVVGADGVGKSALTIQLIQNH (KRAS G12D)
  Core: VVGADGVGK
  misc_feature (5)..(5): Xaa can be Ala, Cys, Phe, His, Ile, Leu, Met, Gln, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXDXVGXSALTIQLIQNH

SEQ ID NO: 26832 - protein, 25 aa, Artificial Sequence
  Description of Artificial Sequence: Synthetic peptide
  Seed: YKLVVVGADGVGKSALTIQLIQNHF (KRAS G12D)
  Core: LVVVGADGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXDGXGKSALTIQLIQNHF

SEQ ID NO: 26833 - protein, 25 aa, Artificial Sequence
  Description of Artificial Sequence: Synthetic peptide
  Seed: YKLVVVGADGVGKSALTIQLIQNHF (KRAS G12D)
  Core: VVGADGVGK
  misc_feature (5)..(5): Xaa can be Ala, Phe, His, Ile, Leu, Met, Gln, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXDXVGXSALTIQLIQNHF

SEQ ID NO: 26834 - protein, 13 aa, Artificial Sequence
  Description of Artificial Sequence: Synthetic peptide
  Seed: EYKLVVVGARGVG (KRAS G12R)
  Core: LVVVGARGV
  misc_feature (4)..(4): Xaa can be Cys, Phe, Ile, Leu, Met, Asn, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXRGXG

SEQ ID NO: 26835 - protein, 14 aa, Artificial Sequence
  Description of Artificial Sequence: Synthetic peptide
  Seed: EYKLVVVGARGVGK (KRAS G12R)
  Core: KLVVVGARG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EYXLVXVXARXVGK

SEQ ID NO: 26836 - protein, 14 aa, Artificial Sequence
  Description of Artificial Sequence: Synthetic peptide
  Seed: EYKLVVVGARGVGK (KRAS G12R)
  Core: LVVVGARGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXRGXGK

SEQ ID NO: 26837 - protein, 15 aa, Artificial Sequence
  Description of Artificial Sequence: Synthetic peptide
  Seed: EYKLVVVGARGVGKS (KRAS G12R)
  Core: KLVVVGARG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EYXLVXVXARXVGKS

SEQ ID NO: 26838 - protein, 15 aa, Artificial Sequence
  Description of Artificial Sequence: Synthetic peptide
  Seed: EYKLVVVGARGVGKS (KRAS G12R)
  Core: LVVVGARGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXRGXGKS

SEQ ID NO: 26839 - protein, 16 aa, Artificial Sequence
  Description of Artificial Sequence: Synthetic peptide
  Seed: EYKLVVVGARGVGKSA (KRAS G12R)
  Core: KLVVVGARG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EYXLVXVXARXVGKSA

SEQ ID NO: 26840 - protein, 16 aa, Artificial Sequence
  Description of Artificial Sequence: Synthetic peptide
  Seed: EYKLVVVGARGVGKSA (KRAS G12R)
  Core: LVVVGARGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXRGXGKSA

SEQ ID NO: 26841 - protein, 17 aa, Artificial Sequence
  Description of Artificial Sequence: Synthetic peptide
  Seed: EYKLVVVGARGVGKSAL (KRAS G12R)
  Core: KLVVVGARG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EYXLVXVXARXVGKSAL

SEQ ID NO: 26842 - protein, 17 aa, Artificial Sequence
  Description of Artificial Sequence: Synthetic peptide
  Seed: EYKLVVVGARGVGKSAL (KRAS G12R)
  Core: LVVVGARGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXRGXGKSAL

SEQ ID NO: 26843 - protein, 18 aa, Artificial Sequence
  Description of Artificial Sequence: Synthetic peptide
  Seed: EYKLVVVGARGVGKSALT (KRAS G12R)
  Core: LVVVGARGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXRGXGKSALT

SEQ ID NO: 26844 - protein, 19 aa, Artificial Sequence
  Description of Artificial Sequence: Synthetic peptide
  Seed: EYKLVVVGARGVGKSALTI (KRAS G12R)
  Core: LVVVGARGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXRGXGKSALTI

SEQ ID NO: 26845 - protein, 20 aa, Artificial Sequence
  Description of Artificial Sequence: Synthetic peptide
  Seed: EYKLVVVGARGVGKSALTIQ (KRAS G12R)
  Core: LVVVGARGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXRGXGKSALTIQ

SEQ ID NO: 26846 - protein, 20 aa, Artificial Sequence
  Description of Artificial Sequence: Synthetic peptide
  Seed: EYKLVVVGARGVGKSALTIQ (KRAS G12R)
  Core: ARGVGKSAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EYKLVVVGXRGXGXSAXTIQ

SEQ ID NO: 26847 - protein, 21 aa, Artificial Sequence
  Description of Artificial Sequence: Synthetic peptide
  Seed: EYKLVVVGARGVGKSALTIQL (KRAS G12R)
  Core: LVVVGARGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXRGXGKSALTIQL

SEQ ID NO: 26848 - protein, 22 aa, Artificial Sequence
  Description of Artificial Sequence: Synthetic peptide
  Seed: EYKLVVVGARGVGKSALTIQLI (KRAS G12R)
  Core: LVVVGARGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXRGXGKSALTIQLI

SEQ ID NO: 26849 - protein, 22 aa, Artificial Sequence
  Description of Artificial Sequence: Synthetic peptide
  Seed: EYKLVVVGARGVGKSALTIQLI (KRAS G12R)
  Core: ARGVGKSAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EYKLVVVGXRGXGXSAXTIQLI

SEQ ID NO: 26850 - protein, 23 aa, Artificial Sequence
  Description of Artificial Sequence: Synthetic peptide
  Seed: EYKLVVVGARGVGKSALTIQLIQ (KRAS G12R)
  Core: LVVVGARGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXRGXGKSALTIQLIQ

SEQ ID NO: 26851 - protein, 23 aa, Artificial Sequence
  Description of Artificial Sequence: Synthetic peptide
  Seed: EYKLVVVGARGVGKSALTIQLIQ (KRAS G12R)
  Core: ARGVGKSAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EYKLVVVGXRGXGXSAXTIQLIQ

SEQ ID NO: 26852 - protein, 24 aa, Artificial Sequence
  Description of Artificial Sequence: Synthetic peptide
  Seed: EYKLVVVGARGVGKSALTIQLIQN (KRAS G12R)
  Core: LVVVGARGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXRGXGKSALTIQLIQN

SEQ ID NO: 26853 - protein, 25 aa, Artificial Sequence
  Description of Artificial Sequence: Synthetic peptide
  Seed: EYKLVVVGARGVGKSALTIQLIQNH (KRAS G12R)
  Core: LVVVGARGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXRGXGKSALTIQLIQNH

SEQ ID NO: 26854 - protein, 13 aa, Artificial Sequence
  Description of Artificial Sequence: Synthetic peptide
  Seed: KLVVVGARGVGKS (KRAS G12R)
  Core: LVVVGARGV
  misc_feature (2)..(2): Xaa can be Cys, Phe, Ile, Leu, Met, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Leu, Met, Asn, Pro, Gln, Ser, Thr, Val, Trp, or Ty r
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXRGXGKS

SEQ ID NO: 26855 - protein, 14 aa, Artificial Sequence
  Description of Artificial Sequence: Synthetic peptide
  Seed: KLVVVGARGVGKSA (KRAS G12R)
  Core: LVVVGARGV
  misc_feature (2)..(2): Xaa can be Ala, Cys, Phe, His, Ile, Leu, Met, Asn, Pro, Gln, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXRGXGKSA

SEQ ID NO: 26856 - protein, 14 aa, Artificial Sequence
  Description of Artificial Sequence: Synthetic peptide
  Seed: KLVVVGARGVGKSA (KRAS G12R)
  Core: VVGARGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXRXVGXSA

SEQ ID NO: 26857 - protein, 15 aa, Artificial Sequence
  Description of Artificial Sequence: Synthetic peptide
  Seed: KLVVVGARGVGKSAL (KRAS G12R)
  Core: LVVVGARGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXRGXGKSAL

SEQ ID NO: 26858 - protein, 15 aa, Artificial Sequence
  Description of Artificial Sequence: Synthetic peptide
  Seed: KLVVVGARGVGKSAL (KRAS G12R)
  Core: VVGARGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXRXVGXSAL

SEQ ID NO: 26859 - protein, 16 aa, Artificial Sequence
  Description of Artificial Sequence: Synthetic peptide
  Seed: KLVVVGARGVGKSALT (KRAS G12R)
  Core: LVVVGARGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXRGXGKSALT

SEQ ID NO: 26860 - protein, 16 aa, Artificial Sequence
  Description of Artificial Sequence: Synthetic peptide
  Seed: KLVVVGARGVGKSALT (KRAS G12R)
  Core: VVGARGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXRXVGXSALT

SEQ ID NO: 26861 - protein, 16 aa, Artificial Sequence
  Description of Artificial Sequence: Synthetic peptide
  Seed: KLVVVGARGVGKSALT (KRAS G12R)
  Core: GARGVGKSA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Phe, Gly, His, Ile, Met, Asn, Pro, Ser, Thr, Val, or Trp
  misc_feature (11)..(11): Xaa can be Ala, Cys, Asp, Glu, Phe, Gly, Ile, Leu, Met, Asn, Pro, Gln, Ser, Thr, Val, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KLVVVXARXVXKSXLT

SEQ ID NO: 26862 - protein, 17 aa, Artificial Sequence
  Description of Artificial Sequence: Synthetic peptide
  Seed: KLVVVGARGVGKSALTI (KRAS G12R)
  Core: LVVVGARGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXRGXGKSALTI

SEQ ID NO: 26863 - protein, 17 aa, Artificial Sequence
  Description of Artificial Sequence: Synthetic peptide
  Seed: KLVVVGARGVGKSALTI (KRAS G12R)
  Core: VVGARGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXRXVGXSALTI

SEQ ID NO: 26864 - protein, 18 aa, Artificial Sequence
  Description of Artificial Sequence: Synthetic peptide
  Seed: KLVVVGARGVGKSALTIQ (KRAS G12R)
  Core: LVVVGARGV
  misc_feature (2)..(2): Xaa can be Cys, Phe, Ile, Leu, Met, Val, Trp, or Tyr
  misc_feature (5)..(5): Xaa can be Ala, Cys, Glu, Phe, Gly, His, Ile, Leu, Met, Asn, Gln, Ser, Thr, Val, Trp, or Tyr
  misc_feature (7)..(7): Xaa can be Ala, Cys, Asp, Glu, Gly, His, Ile, Leu, Met, Asn, Pro, Gln, Ser, Thr, or Val
  misc_feature (10)..(10): Xaa can be Ala, Cys, Phe, Gly, His, Ile, Lys, Leu, Met, Asn, Pro, Gln, Arg, Ser, Thr, Val, Trp, or Ty r
KXVVXGXRGXGKSALTIQ

SEQ ID NO: 26865 - protein, 19 aa, Artificial Sequence
  Description of Artificial Sequence: Synthetic peptide
  Seed: KLVVVGARGVGKSALTIQL (KRAS G12R)
  Core: LVVVGARGV
  misc_feature (2)..(2): Xaa can be Ala, Cys, Asp, Glu, Phe, His, Ile, Leu, Met, Asn, Pro, Gln, Arg, Ser, Thr, Val, Trp, or Ty r
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXRGXGKSALTIQL

SEQ ID NO: 26866 - protein, 19 aa, Artificial Sequence
  Description of Artificial Sequence: Synthetic peptide
  Seed: KLVVVGARGVGKSALTIQL (KRAS G12R)
  Core: ARGVGKSAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KLVVVGXRGXGXSAXTIQL

SEQ ID NO: 26867 - protein, 20 aa, Artificial Sequence
  Description of Artificial Sequence: Synthetic peptide
  Seed: KLVVVGARGVGKSALTIQLI (KRAS G12R)
  Core: LVVVGARGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXRGXGKSALTIQLI

SEQ ID NO: 26868 - protein, 20 aa, Artificial Sequence
  Description of Artificial Sequence: Synthetic peptide
  Seed: KLVVVGARGVGKSALTIQLI (KRAS G12R)
  Core: ARGVGKSAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KLVVVGXRGXGXSAXTIQLI

SEQ ID NO: 26869 - protein, 21 aa, Artificial Sequence
  Description of Artificial Sequence: Synthetic peptide
  Seed: KLVVVGARGVGKSALTIQLIQ (KRAS G12R)
  Core: LVVVGARGV
  misc_feature (2)..(2): Xaa can be Ala, Cys, Asp, Glu, Phe, Gly, His, Ile, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXRGXGKSALTIQLIQ

SEQ ID NO: 26870 - protein, 21 aa, Artificial Sequence
  Description of Artificial Sequence: Synthetic peptide
  Seed: KLVVVGARGVGKSALTIQLIQ (KRAS G12R)
  Core: VVGARGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXRXVGXSALTIQLIQ

SEQ ID NO: 26871 - protein, 21 aa, Artificial Sequence
  Description of Artificial Sequence: Synthetic peptide
  Seed: KLVVVGARGVGKSALTIQLIQ (KRAS G12R)
  Core: ARGVGKSAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KLVVVGXRGXGXSAXTIQLIQ

SEQ ID NO: 26872 - protein, 22 aa, Artificial Sequence
  Description of Artificial Sequence: Synthetic peptide
  Seed: KLVVVGARGVGKSALTIQLIQN (KRAS G12R)
  Core: LVVVGARGV
  misc_feature (2)..(2): Xaa can be Ala, Cys, Glu, Phe, Gly, His, Ile, Leu, Met, Asn, Pro, Gln, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXRGXGKSALTIQLIQN

SEQ ID NO: 26873 - protein, 22 aa, Artificial Sequence
  Description of Artificial Sequence: Synthetic peptide
  Seed: KLVVVGARGVGKSALTIQLIQN (KRAS G12R)
  Core: VVGARGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXRXVGXSALTIQLIQN

SEQ ID NO: 26874 - protein, 23 aa, Artificial Sequence
  Description of Artificial Sequence: Synthetic peptide
  Seed: KLVVVGARGVGKSALTIQLIQNH (KRAS G12R)
  Core: LVVVGARGV
  misc_feature (2)..(2): Xaa can be Ala, Cys, Phe, Ile, Leu, Met, Asn, Pro, Gln, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXRGXGKSALTIQLIQNH

SEQ ID NO: 26875 - protein, 23 aa, Artificial Sequence
  Description of Artificial Sequence: Synthetic peptide
  Seed: KLVVVGARGVGKSALTIQLIQNH (KRAS G12R)
  Core: VVGARGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXRXVGXSALTIQLIQNH

SEQ ID NO: 26876 - protein, 24 aa, Artificial Sequence
  Description of Artificial Sequence: Synthetic peptide
  Seed: KLVVVGARGVGKSALTIQLIQNHF (KRAS G12R)
  Core: LVVVGARGV
  misc_feature (2)..(2): Xaa can be Ala, Cys, Phe, Ile, Leu, Met, Asn, Pro, Gln, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXRGXGKSALTIQLIQNHF

SEQ ID NO: 26877 - protein, 24 aa, Artificial Sequence
  Description of Artificial Sequence: Synthetic peptide
  Seed: KLVVVGARGVGKSALTIQLIQNHF (KRAS G12R)
  Core: VVGARGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXRXVGXSALTIQLIQNHF

SEQ ID NO: 26878 - protein, 25 aa, Artificial Sequence
  Description of Artificial Sequence: Synthetic peptide
  Seed: KLVVVGARGVGKSALTIQLIQNHFV (KRAS G12R)
  Core: LVVVGARGV
  misc_feature (2)..(2): Xaa can be Ala, Cys, Asp, Glu, Phe, His, Ile, Lys, Leu, Met, Asn, Pro, Gln, Arg, Thr, Val, Trp, or Ty r
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXRGXGKSALTIQLIQNHFV

SEQ ID NO: 26879 - protein, 25 aa, Artificial Sequence
  Description of Artificial Sequence: Synthetic peptide
  Seed: KLVVVGARGVGKSALTIQLIQNHFV (KRAS G12R)
  Core: VVGARGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXRXVGXSALTIQLIQNHFV

SEQ ID NO: 26880 - protein, 25 aa, Artificial Sequence
  Description of Artificial Sequence: Synthetic peptide
  Seed: KLVVVGARGVGKSALTIQLIQNHFV (KRAS G12R)
  Core: ARGVGKSAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KLVVVGXRGXGXSAXTIQLIQNHFV

SEQ ID NO: 26881 - protein, 14 aa, Artificial Sequence
  Description of Artificial Sequence: Synthetic peptide
  Seed: LVVVGARGVGKSAL (KRAS G12R)
  Core: VVGARGVGK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXRXVGXSAL

SEQ ID NO: 26882 - protein, 15 aa, Artificial Sequence
  Description of Artificial Sequence: Synthetic peptide
  Seed: LVVVGARGVGKSALT (KRAS G12R)
  Core: VVGARGVGK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXRXVGXSALT

SEQ ID NO: 26883 - protein, 15 aa, Artificial Sequence
  Description of Artificial Sequence: Synthetic peptide
  Seed: LVVVGARGVGKSALT (KRAS G12R)
  Core: GARGVGKSA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVVVXARXVXKSXLT

SEQ ID NO: 26884 - protein, 15 aa, Artificial Sequence
  Description of Artificial Sequence: Synthetic peptide
  Seed: LVVVGARGVGKSALT (KRAS G12R)
  Core: ARGVGKSAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVVVGXRGXGXSAXT

SEQ ID NO: 26885 - protein, 16 aa, Artificial Sequence
  Description of Artificial Sequence: Synthetic peptide
  Seed: LVVVGARGVGKSALTI (KRAS G12R)
  Core: VVGARGVGK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXRXVGXSALTI

SEQ ID NO: 26886 - protein, 16 aa, Artificial Sequence
  Description of Artificial Sequence: Synthetic peptide
  Seed: LVVVGARGVGKSALTI (KRAS G12R)
  Core: GARGVGKSA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVVVXARXVXKSXLTI

SEQ ID NO: 26887 - protein, 16 aa, Artificial Sequence
  Description of Artificial Sequence: Synthetic peptide
  Seed: LVVVGARGVGKSALTI (KRAS G12R)
  Core: ARGVGKSAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVVVGXRGXGXSAXTI

SEQ ID NO: 26888 - protein, 17 aa, Artificial Sequence
  Description of Artificial Sequence: Synthetic peptide
  Seed: LVVVGARGVGKSALTIQ (KRAS G12R)
  Core: VVGARGVGK
  misc_feature (3)..(3): Xaa can be Ala, Cys, Glu, Phe, His, Ile, Leu, Met, Asn, Pro, Gln, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXRXVGXSALTIQ

SEQ ID NO: 26889 - protein, 17 aa, Artificial Sequence
  Description of Artificial Sequence: Synthetic peptide
  Seed: LVVVGARGVGKSALTIQ (KRAS G12R)
  Core: ARGVGKSAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVVVGXRGXGXSAXTIQ

SEQ ID NO: 26890 - protein, 19 aa, Artificial Sequence
  Description of Artificial Sequence: Synthetic peptide
  Seed: LVVVGARGVGKSALTIQLI (KRAS G12R)
  Core: LVVVGARGV
  misc_feature (1)..(1): Xaa can be Ala, Cys, Glu, Phe, Ile, Leu, Met, Gln, Thr, Val, Trp, or Tyr
  misc_feature (4)..(4): Xaa can be Phe, Ile, Leu, Met, Asn, Val, Trp, or Tyr
  misc_feature (6)..(6): Xaa can be Ala, Cys, Asp, Glu, Gly, Ile, Leu, Met, Asn, Pro, Gln, Ser, Thr, or Val
  misc_feature (9)..(9): Xaa can be Ala, Cys, Asp, Glu, Phe, Gly, His, Ile, Leu, Met, Asn, Pro, Gln, Ser, Thr, Val, or Tyr
XVVXGXRGXGKSALTIQLI

SEQ ID NO: 26891 - protein, 19 aa, Artificial Sequence
  Description of Artificial Sequence: Synthetic peptide
  Seed: LVVVGARGVGKSALTIQLI (KRAS G12R)
  Core: ARGVGKSAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVVVGXRGXGXSAXTIQLI

SEQ ID NO: 26892 - protein, 20 aa, Artificial Sequence
  Description of Artificial Sequence: Synthetic peptide
  Seed: LVVVGARGVGKSALTIQLIQ (KRAS G12R)
  Core: VVGARGVGK
  misc_feature (3)..(3): Xaa can be Ala, Cys, Asp, Glu, Phe, Gly, His, Ile, Lys, Leu, Met, Asn, Pro, Gln, Arg, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXRXVGXSALTIQLIQ

SEQ ID NO: 26893 - protein, 20 aa, Artificial Sequence
  Description of Artificial Sequence: Synthetic peptide
  Seed: LVVVGARGVGKSALTIQLIQ (KRAS G12R)
  Core: ARGVGKSAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVVVGXRGXGXSAXTIQLIQ

SEQ ID NO: 26894 - protein, 22 aa, Artificial Sequence
  Description of Artificial Sequence: Synthetic peptide
  Seed: LVVVGARGVGKSALTIQLIQNH (KRAS G12R)
  Core: VVGARGVGK
  misc_feature (3)..(3): Xaa can be Phe, Ile, Leu, Met, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Gly, His, Ile, Lys, Asn, Pro, Gln, Arg, Ser, Thr, Val, or Tyr
  misc_feature (11)..(11): Xaa can be Ala, Cys, Asp, Glu, Phe, Gly, His, Lys, Leu, Met, Asn, Pro, Gln, Arg, Ser, Thr, Val, or Ty r
LVXVGXRXVGXSALTIQLIQNH

SEQ ID NO: 26895 - protein, 22 aa, Artificial Sequence
  Description of Artificial Sequence: Synthetic peptide
  Seed: LVVVGARGVGKSALTIQLIQNH (KRAS G12R)
  Core: ARGVGKSAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVVVGXRGXGXSAXTIQLIQNH

SEQ ID NO: 26896 - protein, 23 aa, Artificial Sequence
  Description of Artificial Sequence: Synthetic peptide
  Seed: LVVVGARGVGKSALTIQLIQNHF (KRAS G12R)
  Core: ARGVGKSAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVVVGXRGXGXSAXTIQLIQNHF

SEQ ID NO: 26897 - protein, 14 aa, Artificial Sequence
  Description of Artificial Sequence: Synthetic peptide
  Seed: MTEYKLVVVGARGV (KRAS G12R)
  Core: LVVVGARGV
  misc_feature (6)..(6): Xaa can be Ala, Cys, Asp, Phe, Gly, His, Ile, Lys, Leu, Met, Asn, Gln, Arg, Ser, Thr, Val, Trp, or Ty r
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXRGX

SEQ ID NO: 26898 - protein, 15 aa, Artificial Sequence
  Description of Artificial Sequence: Synthetic peptide
  Seed: MTEYKLVVVGARGVG (KRAS G12R)
  Core: LVVVGARGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXRGXG

SEQ ID NO: 26899 - protein, 16 aa, Artificial Sequence
  Description of Artificial Sequence: Synthetic peptide
  Seed: MTEYKLVVVGARGVGK (KRAS G12R)
  Core: KLVVVGARG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTEYXLVXVXARXVGK

SEQ ID NO: 26900 - protein, 16 aa, Artificial Sequence
  Description of Artificial Sequence: Synthetic peptide
  Seed: MTEYKLVVVGARGVGK (KRAS G12R)
  Core: LVVVGARGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXRGXGK

SEQ ID NO: 26901 - protein, 17 aa, Artificial Sequence
  Description of Artificial Sequence: Synthetic peptide
  Seed: MTEYKLVVVGARGVGKS (KRAS G12R)
  Core: KLVVVGARG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTEYXLVXVXARXVGKS

SEQ ID NO: 26902 - protein, 17 aa, Artificial Sequence
  Description of Artificial Sequence: Synthetic peptide
  Seed: MTEYKLVVVGARGVGKS (KRAS G12R)
  Core: LVVVGARGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXRGXGKS
